(12) United States Patent
Pedersen et al.

(10) Patent No.: US 12,116,576 B2
(45) Date of Patent: Oct. 15, 2024

(54) OLIGONUCLEOTIDES FOR MODULATING SCN9A EXPRESSION

(71) Applicant: Hoffmann-La Roche Inc., Little Falls, NJ (US)

(72) Inventors: Lykke Pedersen, Copenhagen (DK); Søren Rasmussen, Espergærde (DK); Gianluigi Lichinchi, Hørsholm (DK); Christoffer Sondergaard, Hørsholm (DK)

(73) Assignee: Hoffmann-La Roche Inc., Little Falls, NJ (US)

(*) Notice: Subject to any disclaimer, the term of this patent is extended or adjusted under 35 U.S.C. 154(b) by 244 days.

(21) Appl. No.: 17/130,451

(22) Filed: Dec. 22, 2020

(65) Prior Publication Data

US 2021/0238608 A1   Aug. 5, 2021

Related U.S. Application Data

(63) Continuation of application No. PCT/EP2019/066223, filed on Jun. 19, 2019.

(30) Foreign Application Priority Data

Jun. 22, 2018  (EP) .................................... 18179339
Sep. 18, 2018  (EP) .................................... 18194982

(51) Int. Cl.
  *C12N 15/113*    (2010.01)
  *A61K 47/54*     (2017.01)

(52) U.S. Cl.
  CPC ........ *C12N 15/1138* (2013.01); *A61K 47/549* (2017.08); *C12N 2310/11* (2013.01); *C12N 2310/14* (2013.01); *C12N 2310/315* (2013.01); *C12N 2310/321* (2013.01); *C12N 2310/322* (2013.01); *C12N 2310/3231* (2013.01); *C12N 2310/341* (2013.01); *C12N 2310/351* (2013.01)

(58) Field of Classification Search
  None
  See application file for complete search history.

(56) References Cited

U.S. PATENT DOCUMENTS

| | | | |
|---|---|---|---|
| 7,691,997 B2 | 4/2010 | Khvorova et al. | |
| 2005/0080031 A1* | 4/2005 | McSwiggen ........... | C12N 15/87 536/23.1 |
| 2007/0026394 A1* | 2/2007 | Blatt .................... | C12N 15/113 435/372 |
| 2007/0212685 A1 | 9/2007 | MacDonald et al. | |
| 2010/0273857 A1 | 10/2010 | Thakker et al. | |
| 2011/0306654 A1 | 12/2011 | MacDonald et al. | |
| 2016/0024208 A1 | 1/2016 | MacDonald et al. | |
| 2017/0283496 A1 | 10/2017 | Pedersen et al. | |
| 2019/0153477 A1* | 5/2019 | Lundberg ............... | C12N 15/11 |

FOREIGN PATENT DOCUMENTS

| | | |
|---|---|---|
| JP | 2019-531287 A | 10/2019 |
| KR | 2011-0087436 A | 8/2011 |
| WO | WO-01/05831 A1 | 1/2001 |
| WO | WO-02/18637 A2 | 3/2002 |
| WO | WO-02/083945 A2 | 10/2002 |
| WO | WO-02/18637 A3 | 11/2002 |
| WO | WO-02/083945 A3 | 10/2003 |
| WO | WO-2007/056326 A2 | 5/2007 |
| WO | WO-2012/162732 A1 | 12/2012 |
| WO | WO-2014/159595 A2 | 10/2014 |
| WO | WO-2014/159595 A3 | 12/2014 |
| WO | WO-2018/007980 A1 | 1/2018 |
| WO | WO-2018/051175 A1 | 3/2018 |
| WO | WO-2019/138057 A1 | 7/2019 |
| WO | WO-2019/141723 A1 | 7/2019 |
| WO | WO-2019/233921 A1 | 12/2019 |
| WO | WO-2020/002487 A1 | 1/2020 |
| WO | WO-2021/008637 A3 | 8/2021 |

OTHER PUBLICATIONS

Cai et al., "shRNA mediated knockdown of Nav1.7 in rat dorsal root ganglion attenuates pain following burn injury," BMC Anesthesiol. 16(59) 1-7 (2016).
Campbell et al., "Functional expression of the voltage-gated Na+-channel Nav1.7 is necessary for EGF-mediated invasion in human non-small cell lung cancer cells," J Cell Sci. 126(21): 4939-49 (2013).
Cox et al., "An SCN9A channelopathy causes congenital inability to experience pain," Nature. 444(7121): 894-898 (2006).
Cummins et al., "Electrophysiological Properties of Mutant Nav1.7 Sodium Channels in a Painful Inherited Neuropathy," J Neurosci. 24(38): 8232-8236 (2004).
Fertleman et al., "What's in a name-familial rectal pain syndrome becomes paroxysmal extreme pain disorder," J Neurol Neurosurg Psychiatry. 77(11) 1294-1295 (2006).
Khasar et al., "A tetrodotoxin-resistant sodium current mediates inflammatory pain in the rat," Neurosci Lett. 256(1): 17-20 (1998).
Kis-Toth et al., "Voltage-Gated Sodium Channel Nav1.7 Maintains the Membrane Potential and Regulates the Activation and Chemokine-Induced Migration of a Monocyte-Derived Dendritic Cell Subset," J Immunol. 187(3): 1273-1280 (2011) (9 pages).
Li et al., "Chitosan oligosaccharide reduces Propofol requirements and Propofol-related side effects," Mar Drugs.14(12): 234 (2016) (16 pages).
Meguro et al., "Function and role of voltage-gated sodium channel NaV1. 7 expressed in aortic smooth muscle cells," Am J Physiol Heart Circ Physiol. 296(1): H211-H219 (2009).
Mohan et al., "Antisense oligonucleotides selectively suppress target RNA in nociceptive neurons of the pain system and can ameliorate mechanical pain," J of the Int Assoc for the Study of Pain. 159(1): 139-149 (2018).

(Continued)

*Primary Examiner* — Sean McGarry
(74) *Attorney, Agent, or Firm* — Clark & Elbing LLP; Thomas J. Takara

(57) ABSTRACT

The present invention relates to oligonucleotides (oligomers) that are complementary to voltage-gated sodium ion channel encoding nucleic acids, such as SCN9A, which encodes the voltage-gated sodium channel $Na_v1.7$. The oligonucleotides of the invention are capable of inhibiting the expression of voltage-gated sodium ion channels, such as $Na_v1.7$, and are useful in the prevention or the treatment of pain.

16 Claims, No Drawings

Specification includes a Sequence Listing.

(56) References Cited

OTHER PUBLICATIONS

Muroi et al., "Selective silencing of NaV1.7 decreases excitability and conduction in vagal sensory neurons," J Physiol. 589(23): 5663-5676 (2011).

Nakajima et al., "Eicosapentaenoic acid inhibits voltage-gated sodium channels and invasiveness in prostate cancer cells," Br J Pharmacol. 156(3): 420-431 (2009).

Nassar et al., "Nociceptor-specific gene deletion reveals a major role for Nav1.7 (PN1) in acute and inflammatory pain," Proc Natl Acas Sci U S A. 101(34): 12706-11 (2004).

Pan et al., "Effect of down-regulation of voltage-gated sodium channel Nav1.7 on activation of astrocytes and microglia in DRG in rats with cancer pain," Asian Pac J Trop Med. 8(5): 405-411 (2015).

Parada et al., "Activation of presynaptic NMDA receptors coupled to NaV1.8-resistant sodium channel C-fibers causes retrograde mechanical nociceptor sensitization," Proc Natl Acad U S A. 100(5): 2923-8 (2003).

Porreca et al., "A comparison of the potential role of the tetrodotoxin-insensitive sodium channels, PN3ySNS and NaNySNS2, in rat models of chronic pain," *Proc Natl Acad Sci U S A*. 96(14): 7640-4 (1999) (6 pages).

Ruangsri et al., "Relationship of Axonal Voltage-gated Sodium Channel 1.8 (NaV1.8) mRNA accumulation to sciatic nerve injury-induced painful neuropathy in rats," J Biol Chem. 286(46): 39836-39847 (2011).

Sun et al., "Increased Nav1.7 expression in the dorsal root ganglion contributes to pain hypersensitivity after plantar incision in rats," Mol Pain. 14:1-8 (2018), including Supplementary Figures "Figure", A X ' Jun. 19, 2018 (Jun. 19, 2018), XP55624115, Retrieved from the Internet: URL:https://journals.sagepub.com/doi/suppl /10.1177/1744806918782323/suppl_file/Supplementary Figures.pdf [retrieved on Sep. 19, 2819].

Yamane et al., "A functional coupling between CRMPI and Nav1.7 for retrograde propagation of Semaphorin3A signaling," J Cell Sci. 130(8): 1393-1403 (2017).

Yang et al., "Mutations in SCN9A, encoding a sodium channel alpha subunit, in patients with primary erythermalgia," J Med Genet. 41(3):171-174 (2004).

Yoshimura et al., "The involvement of the tetrodotoxin-resistant sodium channel NaV1.8 (PN3/SNS) in a rat model of visceral pain," J Neurosci. 21(21): 8690-6 (2001).

International Search Report and Written Opinion for International Patent Application No. PCT/EP2019/066223, dated Oct. 2, 2019 (21 pages).

Nassar et al., "Neuropathic pain develops normally in mice lacking both $Na_v$ 1.7 and $Na_v$ 1.8," Mol Pain. 1:24 (2004) (9 pages).

Wan et al., "The Medicinal Chemistry of Therapeutic Oligonucleotides," J Med Chem. 59(21):9645-9667 (2016) (23 pages).

Yu et al., "Antisense-Mediated Knockdown of $Na_v$1.8, but Not $Na_v$1.9, Generates Inhibitory Effects on Complete Freund's Adjuvant-Induced Inflammatory Pain in Rat," PLoS One, 6(5):e19865 (2011) (9 pages).

Koch et al., Chapter 19: Locked Nucleic Acid. *Antisense Drug Technology: Principles, Strategies, and Applications, Second Edition*. Stanley T. Crooke, 519-64 (2008).

Smith et al., "Therapeutic Oligonucleotides: State of the Art," Annu Rev Pharmacol Toxicol. 59:605-30 (Oct. 9, 2018).

Sun et al., "Increased Nav1.7 expression in the dorsal root ganglion contributes to pain hypersensitivity after plantar incision in rats," Molecular Pain. 14:1-8 (May 7, 2018) (10 pages).

Vickers et al., "Efficient Reduction of Target RNAs by Small Interfering RNA and RNase H-dependent Antisense Agents", 2003, J. of Biol. Chem., vol. 278(9), 7108-7118 (Year: 2003).

* cited by examiner

OLIGONUCLEOTIDES FOR MODULATING SCN9A EXPRESSION

SEQUENCE LISTING

The instant application contains a Sequence Listing which has been submitted electronically in ASCII format and is hereby incorporated by reference in its entirety. Said ASCII copy, created on Jan. 19, 2021 is named "51551-003001_Sequence_Listing_1.19.21_ST25" and is 2,511,302 bytes in size.

FIELD OF INVENTION

The present invention relates to oligonucleotides (oligomers) that are complementary to voltage-gated sodium ion channel encoding nucleic acids, such as SCN9A, which encodes the voltage-gated sodium channel $Na_v1.7$. The oligonucleotides of the invention are capable of inhibiting the expression of voltage-gated sodium ion channels, such as $Na_v1.7$, and are useful in the prevention or the treatment of pain.

BACKGROUND

Voltage-gated sodium channels ($Na_vs$) play essential roles in excitable tissues, with their activation and opening resulting in the initial phase of the action potential. The cycling of $Na_vs$ through open, closed and inactivated states, and their closely choreographed relationships with the activities of other ion channels lead to exquisite control of intracellular ion concentrations $Na_v1.7$ is a voltage activated ion channel involved expressed almost exclusively in the small cell peripheral sensory nerves. Mice with a conditional knock-out of $Na_v1.7$ in sensory neurons displayed an antinociceptive phenotype (Nassar et al., 2004, Proc Natl Acad Sci USA. 2004 Aug. 24; 101(34):12706-11). The role of $Na_v1.7$ in pain sensation in humans was demonstrated by association between the spontaneous pain syndrome inherited erythromelalgia (IEM) (Yang et al., J Med Genet. 2004; 41(3):171-4) and paroxysmal extreme pain disorder (PEPD) (Fertleman et al., J Neurol Neurosurg Psychiatry. 2006 November; 77(11):1294-5) and gain of function mutation in Nav1.7 of these patients (Cummins et al., J Neurosci. 2004; 24(38):8232-8236). Further support for Nav1.7 was generated by identification of loss of function mutations that resulted in congenital insensitivity to pain (Cox et al., Nature AAA. 2006; 7121:894-8). These findings have kicked of a number of small molecule drug discovery programs for identification of $Na_v1.7$ modulators, however it appears that finding good compounds with high selectivity and good PK/PD properties have been challenging.

US2016024208 discloses human antibodies to $Na_v1.7$.

WO02083945 refers to synthetic oligonucleotides with antisense sequence to specific regions of SCN5A and optionally also SCN9A for use in the treatment of breast cancer.

US2007/212685 refers to methods of identifying analgesic agents and mentions that specific compounds which will modulate the gene expression or gene transcript levels in a cell of SCN9A include antisense nucleic acids.

US2010273857A refers to methods, sequences and nucleic acid molecules used to treat pain via locally administering siRNA molecules that suppress the expression of amino acid sequences that encode for Nav1.7 channels or that otherwise inhibit the function of Nav1.7 channels, and reports that local suppression of Nav1.7 channel levels and/or function will occur in the peripheral sensory neurons of the dorsal root ganglia.

WO12162732 relates to novel screening assays for modulating sodium channels, particularly voltage-gated sodium channels.

KR20110087436 discloses an SCN9A antisense oligonucleotide.

Mohan et al., Pain (2018) Volume 159 Number 1, p139-149 discloses antisense oligonucleotides targeting $Na_v1.7$, and characterize the pharmacodynamic activity of ASOs in spinal cord and dorsal root ganglia (DRG) in rodents.

WO18051175 discloses SCN9A antisense peptide nucleic acid oligonucleotides targeting a part of the human SCN9A pre-mRNA. The peptide nucleic acid derivatives potently induce splice variants of the SCN9A mRNA in cells, and are useful to safely treat pains or conditions involving Nav1.7 activity.

There is therefore a need for antisense oligonucleotides therapeutics which are effective in inhibiting expression of voltage-gated sodium ion channel encoding nucleic acids, such as SCN9A in humans, such as for the prevention or treatment of pain.

OBJECTIVE OF THE INVENTION

The present invention provides oligonucleotides, including LNA antisense oligonucleotides targeting SCN9A which are capable of inhibiting the expression of $Na_v1.7$ in a cell which is expressing $Na_v1.7$. The present invention further provides oligonucleotides targeting SCN10A which inhibit the expression of $Na_v1.8$ in a cell which is expressing $Na_v1.8$. In some aspects, the invention provides oligonucleotides which target both SCN9A and SCN10A nucleic acid targets. The oligonucleotide of the invention may be used in the prevention or treatment of pain. The invention further provides advantageous target site sequences on the human Nav1.7 pre-mRNA which may be targeted by oligonucleotide inhibitors of human Nav1.7 such as antisense oligonucleotides or RNAi agents, such as siRNAs or shRNAs.

SUMMARY OF INVENTION

The present invention relates to oligonucleotides targeting a nucleic acid encoding a voltage-gated sodium ion channel encoding nucleic acids, such as SCN9A or SCN10A, or in some embodiments both SCN9A (a $Na_v1.7$ nucleic acid target) and SCN10A (a $Na_v1.8$ nucleic acid target).

The oligonucleotide of the invention may be an antisense oligonucleotide.

The oligonucleotides of the invention are capable of inhibiting the expression of the target nucleic acid, such as SCN9A or SCN10A, or in some embodiments are capable of inhibiting the expression of both SCN9A and SCN10A, in a cell which is expressing said target nucleic acid(s). Suitably the target nucleic acid expressed in the cell may be a mammalian cell, such as cynomolgus monkey cell or a pig cell, or preferably a human SCN9A or a human SCN10A mRNA or pre-mRNA sequence.

Alternatively stated, the oligonucleotides of the invention are capable of inhibiting the expression of Nav1.7 or Nav1.8 in a cell, such as a mammalian or human cell, or in some embodiments are capable of inhibiting the expression of both Nav1.7 or Nav1.8 in a cell such as in a mammalian, such as a cynomolgus monkey cell or a pig cell, or preferably in a human cell. The cell is expressing the target voltage-gated sodium ion channel protein.

The invention further provides target sequences of the human SCN9A pre-mRNA which are useful in targeting complementary oligonucleotides for inhibition of SCN9A expression.

Advantageously the oligonucleotide of the invention is an antisense oligonucleotide such as an LNA antisense oligonucleotide.

The invention provides an antisense oligonucleotide (e.g. an LNA antisense oligonucleotide) of 10 to 30 nucleotides in length, which comprises a contiguous nucleotide sequence of 10 to 30 nucleotides in length with at least 90% complementarity, such as 100% complementarity, to SEQ ID NO: 1.

The invention provides for an oligonucleotide of 10 to 30 nucleotides in length, which comprises a contiguous nucleotide sequence of 10 to 30 nucleotides in length with at least 90% complementarity, such as 100% complementarity, to SEQ ID NO: 1, which is capable of inhibiting the expression of capable of inhibiting the expression of both Nav1.7 and Nav1.8 in a cell, wherein the contiguous nucleotide sequence is complementary to human Nav1.7 and human Nav1.8 target nucleic acids, for example the target nucleic acids shown as SEQ ID NO 1 and SEQ ID NO 651 respectively.

The invention provides for an oligonucleotide of 10 to 30 nucleotides in length, which comprises a contiguous nucleotide sequence of 10 to 30 nucleotides in length with at least 90% complementarity, such as 100% complementarity, to a human Nav1.7 target nucleic acid and a human Nav1.8 target nucleic acid, and is which is capable of inhibiting the expression of capable of inhibiting the expression of both Nav1.7 or Nav1.8 in a cell. In some embodiments, the contiguous nucleotide sequence of the oligonucleotide of the invention is 100% complementary to SEQ ID NO 1, and is at least 90% complementary such as advantageously 100% complementary to SEQ ID NO 651.

The invention provides for an oligonucleotide of 10 to 30 nucleotides in length, which comprises a contiguous nucleotide sequence of 10 to 30 nucleotides in length with at least 90% complementarity, such as 100% complementarity, to SEQ ID NO: 1, which is capable of inhibiting the expression of capable of inhibiting the expression of both Nav1.7 or Nav1.8 in a cell, wherein the contiguous nucleotide sequence is 100% complementary to SEQ ID NO 1 and is at least 90% complementary such as 100% complementary to SEQ ID NO 651.

In some embodiments, the oligonucleotide of the invention comprises at least 10, or at least 12 contiguous nucleosides present in a sequence selected from the group consisting of SEQ ID NOs 512, 513, 514, 515, 516, 517, 518, 519, 520, 521, 522, 523, 524, 525, 557, 558, 559, 560, 577, 579, 583, 638, and 587.

The invention provides an antisense oligonucleotide selected from the group consisting of CMP ID 50_1; 51_1; 52_1; 53_1; 54_1; 55_1; 56_1; 57_1; 58_1; 59_1; 60_1; 61_1; 62_1; 63_1; 64_1; 65_1; 66_1; 67_1; 68_1; 69_1; 70_1; 71_1; 72_1; 73_1; 74_1; 75_1; 76_1; 77_1; 78_1; 79_1; 80_1; 81_1; 82_1; 83_1; 84_1; 85_1; 86_1; 87_1; 88_1; 89_1; 90_1; 91_1; 92_1; 93_1; 94_1; 95_1; 96_1; 97_1; 98_1; 99_1; 100_1; 101_1; 102_1; 103_1; 104_1; 105_1; 106_1; 107_1; 108_1; 109_1; 110_1; 111_1; 112_1; 113_1; 114_1; 115_1; 116_1; 117_1; 118_1; 119_1; 120_1; 121_1; 122_1; 123_1; 124_1; 125_1; 126_1; 127_1; 128_1; 129_1; 130_1; 131_1; 132_1; 133_1; 134_1; 135_1; 136_1; 137_1; 138_1; 139_1; 140_1; 141_1; 142_1; 143_1; 144_1; 145_1; 146_1; 147_1; 148_1; 149_1; 150_1; 151_1; 152_1; 153_1; 154_1; 155_1; 156_1; 157_1; 158_1; 159_1; 160_1; 161_1; 162_1; 163_1; 164_1; 165_1; 166_1; 167_1; 168_1; 169_1; 170_1; 171_1; 172_1; 173_1; 174_1; 175_1; 176_1; 177_1; 178_1; 179_1; 180_1; 181_1; 182_1; 183_1; 184_1; 185_1; 186_1; 187_1; 188_1; 189_1; 190_1; 191_1; 192_1; 193_1; 194_1; 195_1; 196_1; 197_1; 198_1; 199_1; 200_1; 201_1; 202_1; 203_1; 204_1; 205_1; 206_1; 207_1; 208_1; 209_1; 210_1; 211_1; 212_1; 213_1; 214_1; 215_1; 216_1; 217_1; 218_1; 219_1; 220_1; 221_1; 222_1; 223_1; 224_1; 225_1; 226_1; 227_1; 228_1; 229_1; 230_1; 231_1; 232_1; 233_1; 234_1; 235_1; 236_1; 237_1; 238_1; 239_1; 240_1; 241_1; 242_1; 243_1; 244_1; 245_1; 246_1; 247_1; 248_1; 249_1; 250_1; 251_1; 252_1; 253_1; 254_1; 255_1; 256_1; 257_1; 258_1; 259_1; 260_1; 261_1; 262_1; 263_1; 264_1; 265_1; 266_1; 267_1; 268_1; 269_1; 270_1; 271_1; 272_1; 273_1; 274_1; 275_1; 276_1; 277_1; 278_1; 279_1; 280_1; 281_1; 282_1; 283_1; 284_1; 285_1; 286_1; 287_1; 288_1; 289_1; 290_1; 291_1; 292_1; 293_1; 294_1; 295_1; 296_1; 297_1; 298_1; 299_1; 300_1; 301_1; 302_1; 303_1; 304_1; 305_1; 306_1; 307_1; 308_1; 309_1; 310_1; 311_1; 312_1; 313_1; 314_1; 315_1; 316_1; 317_1; 318_1; 319_1; 320_1; 321_1; 322_1; 323_1; 324_1; 325_1; 326_1; 327_1; 328_1; 329_1; 330_1; 331_1; 332_1; 333_1; 334_1; 335_1; 336_1; 337_1; 338_1; 339_1; 340_1; 341_1; 342_1; 343_1; 344_1; 345_1; 346_1; 347_1; 348_1; 349_1; 350_1; 351_1; 352_1; 353_1; 354_1; 355_1; 356_1; 357_1; 358_1; 359_1; 360_1; 361_1; 362_1; 363_1; 364_1; 365_1; 366_1; 367_1; 368_1; 369_1; 370_1; 371_1; 372_1; 373_1; 374_1; 375_1; 376_1; 377_1; 378_1; 379_1; 380_1; 381_1; 382_1; 383_1; 384_1; 385_1; 386_1; 387_1; 388_1; 389_1; 390_1; 391_1; 392_1; 393_1; 394_1; 395_1; 396_1; 397_1; 398_1; 399_1; 400_1; 401_1; 402_1; 403_1; 404_1; 405_1; 406_1; 407_1; 408_1; 409_1; 410_1; 411_1; 412_1; 413_1; 414_1; 415_1; 416_1; 417_1; 418_1; 419_1; 420_1; 421_1; 422_1; 423_1; 424_1; 425_1; 426_1; 427_1; 428_1; 429_1; 430_1; 431_1; 432_1; 433_1; 434_1; 435_1; 436_1; 437_1; 438_1; 439_1; 440_1; 441_1; 442_1; 443_1; 444_1; 445_1; 446_1; 447_1; 448_1; 449_1; 450_1; 451_1; 452_1; 453_1; 454_1; 455_1; 456_1; 457_1; 458_1; 459_1; 460_1; 461_1; 462_1; 463_1; 464_1; 465_1; 466_1; 4671; 468_1; 469_1; 470_1; 471_1; 472_1; 473_1; 474_1; 475_1; 476_1; 477_1; 478_1; 479_1; 480_1; 481_1; 482_1; 483_1; 484_1; 485_1; 486_1; 487_1; 488_1; 489_1; 490_1; 491_1; 492_1; 493_1; 494_1; 495_1; 496_1; 497_1; 498_1; 499_1; 500_1; 501_1; 502_1; 503_1; 504_1; 505_1; 506_1; 507_1; 508_1; 509_1; 510_1; 511_1; 512_1; 512_2; 512_3; 513_1; 513_2; 513_3; 513_4; 514_1; 514_2; 514_3; 514_4; 515_1; 515_2; 515_3; 515_4; 515_5; 515_6; 516_1; 516_2; 516_3; 516_4; 516_5; 516_6; 516_7; 517_1; 517_2; 517_3; 517_4; 517_5; 517_6; 517_7; 517_8; 518_1; 518_2; 518_3; 518_4; 518_5; 518_6; 519_1; 519_2; 519_3; 519_4; 519_5; 519_6; 520_1; 520_2; 520_3; 520_4; 520_5; 521_1; 521_2; 521_3; 521_4; 521_5; 522_1; 522_2; 522_3; 522_4; 523_1; 523_2; 523_3; 523_4; 523_5; 524_1; 525_1; 526_1; 527_1; 528_1; 529_1; 530_1; 531_1; 532_1; 533_1; 534_1; 535_1; 536_1; 537_1; 538_1; 539_1; 540_1; 541_1; 542_1; 543_1; 544_1; 545_1; 546_1; 547_1; 548_1; 549_1; 550_1; 551_1; 552_1; 553_1; 554_1; 555_1; 556_1; 557_1; 558_1; 559_1; 560_1; 561_1; 562_1; 563_1; 564_1; 565_1; 566_1; 567_1; 568_1; 569_1; 570_1; 571_1; 572_1; 573_1; 574_1; 575_1; 576_1; 577_1; 578_1; 579_1; 580_1; 581_1; 582_1; 583_1; 584_1; 585_1; 586_1; 5871; 588_1; 589_1; 590_1; 591_1; 592_1; 593_1; 594_1; 595_1; 596_1; 597_1; 598_1; 599_1; 600_1; 601_1; 602_1; 603_1; 604_1; 605_1; 606_1; 607_1; 608_1; 609_1; 610_1; 611_1; 612_1; 613_1; 614_1; 615_1; 616_1; 617_1; 618_1; 619_1; 620_1; 621_1; 622_1; 623_1; 624_1; 625_1; 626_1; 627_1; 628_1; 629_1; 630_1; 631_1; 632_1; 633_1; 634_1; 635_1; 636_1; 637_1;

638_1; 639_1; 640_1; and 641_1; or selected from the group selected of 642_1, 643_1, 644_1, 645_1, 646_1, 647_1, 648_1, 649_1 and 650_1.

The invention provides an oligonucleotide capable of inhibiting the expression of human SNC9A in a cell, wherein the oligonucleotide comprises a contiguous nucleotide sequence comprising at least 10 or at least 12 contiguous nucleotides of a sequence selected from the group consisting of 51, 59, 127, 161, 67, 106, 72, 124, 163, 99, 125, 110, 65, 94, 64, 57, 136, 158, 159, 356, 197, 132, 83, 76, 130, 135, 77, 186, 105, 445, 325, 265, 200, 288, 346, 86, 281, 339, 256, 289, 414, 286, 241, 82, 475, 91, 50, 97, 322, 148, 443, 251, 451, 179, 466, 357, 109,472, 471, 376, 413, 270, 379, 416, 311, 411, 368, 333, 347, 152, 89, 380, 390, 429, 63, 90, 415, 199, 503, 476, 92, 268, 371, 302, 485, 205, 274, 122, 419, 470, 498, 156,478, 393, 312, 287, 96, 226, 71, 137, 365, 58, 370, 280, 385, 442, 134, 463, 140, 440, 230, 310, 479, 363, 340, 495, 467, 444, 418, 338, 335, 496, 196, 317, 341, 406, 330, 173, 377, 474, 482, 282, 266, 73, 257, 342, 190, 492, 87, 188, 456, 372, 417, 404, 239, 206, 433, 486, 175, 461, 56, 408, 334, 504, 453, 222, 410, 104, 460, 439, 255, 489, 203, 398, 171, 407, 172, 412, 321, 305, 328, 120, 434, 449, 350, 487, 146, 420, 426, 352, 150, 316, 353, 469, 306, 384, 155, 450, 279, 267, 337, 184, 459, 360, 75, 468, 180, 245, 387, 345, 98, 435, 295, 369, 218, 182, 448, 300, 481, 427, 207, 367, 240, 231, 364, 355, 431, 497, 397, 465, 271, 502, 151, 178, 499, 421, 131, 309, 491, 261, 121, 128, 84, 304, 264, 493, 185, 237, 139, 441, 169, 160, 102, 296, 164, 362, 500, and 100.

The invention provides an oligonucleotide capable of inhibiting the expression of human SNC9A in a cell, wherein the oligonucleotide comprises a contiguous nucleotide sequence comprising at least 10 or at least 12 contiguous nucleotides of a sequence selected from the group consisting of SEQ ID NO 642, 643, 644, 645, 646, 647, 648, 649 and 650.

The invention provides an oligonucleotide capable of inhibiting the expression of human SNC9A in a cell, wherein the oligonucleotide comprises a contiguous nucleotide sequence comprising at least 10 or at least 12 contiguous nucleotides of a sequence selected from the group consisting of SEQ ID NOs 512-641.

The invention provides an oligonucleotide capable of inhibiting the expression of human SNC9A in a cell, wherein the oligonucleotide comprises a contiguous nucleotide sequence comprising at least 10 or at least 12 contiguous nucleotides of a sequence selected from the group consisting of SEQ ID NOs 642-650.

The invention provides an antisense oligonucleotide capable of inhibiting the expression of human SNC9A in a cell, wherein the oligonucleotide comprises a contiguous nucleotide sequence comprising at least 10 or at least 12 contiguous nucleotides of a sequence selected from the group consisting of SEQ ID NOs 512-641.

The invention provides an antisense oligonucleotide capable of inhibiting the expression of human SNC9A in a cell, wherein the oligonucleotide comprises a contiguous nucleotide sequence comprising at least 10 or at least 12 contiguous nucleotides of a sequence selected from the group consisting of SEQ ID NOs 642-650.

The invention provides an antisense gapmer oligonucleotide capable of inhibiting the expression of human SNC9A in a cell, wherein the oligonucleotide comprises a contiguous nucleotide sequence comprising at least 12 contiguous nucleotides of a sequence selected from the group consisting of SEQ ID NOs 512-641.

The invention provides an antisense oligonucleotide capable of inhibiting the expression of human SNC9A in a cell, wherein the oligonucleotide comprises a contiguous nucleotide sequence comprising at least 10 or at least 12 contiguous nucleotides of a sequence selected from the group consisting of SEQ ID NOs 642-650.

The invention provides an antisense gapmer oligonucleotide capable of inhibiting the expression of human SNC9A in a cell, wherein the oligonucleotide comprises a contiguous nucleotide sequence comprising at least 14 contiguous nucleotides of a sequence selected from the group consisting of SEQ ID NOs 512-641.

The invention provides an antisense oligonucleotide capable of inhibiting the expression of human SNC9A in a cell, wherein the oligonucleotide comprises a contiguous nucleotide sequence comprising at least 10 or at least 12 contiguous nucleotides of a sequence selected from the group consisting of SEQ ID NOs 642-650.

The invention provides a conjugate comprising the antisense oligonucleotide according to the invention and at least one conjugate moiety covalently attached to said oligonucleotide.

The invention provides for an oligonucleotide of 10 to 30 nucleotides in length, which comprises a contiguous nucleotide sequence of 10 to 30 nucleotides in length with at least 90% complementarity, such as 100% complementarity, to SEQ ID NO: 1, which is capable of inhibiting the expression of capable of inhibiting the expression of both Nav1.7 or Nav1.8 in a cell.

The invention provides for an antisense oligonucleotide of 10 to 30 nucleotides in length, which comprises a contiguous nucleotide sequence of 10 to 30 nucleotides in length with at least 90% complementarity, such as 100% complementarity, to SEQ ID NO: 1, which is capable of inhibiting the expression of capable of inhibiting the expression of both Nav1.7 or Nav1.8 in a cell.

In some embodiments of the invention the oligonucleotide comprises a contiguous nucleotide sequence which comprises at least 10, or at least 12 contiguous nucleosides present in a sequence selected from the group consisting of SEQ ID NOs 512, 513, 514, 515, 516, 517, 518, 519, 520, 521, 522, 523, 524, 525, 557, 558, 559, 560, 577, 579, 583, 638, and 587.

In some embodiments of the invention the oligonucleotide comprises a contiguous nucleotide sequence which comprises at least 14 contiguous nucleosides present in a sequence selected from the group consisting of SEQ ID NOs 512, 513, 514, 515, 516, 517, 518, 519, 520, 521, 522, 523, 524, 525, 557, 558, 559, 560, 577, 579, 583, 638, and 587.

The invention provides a pharmaceutically acceptable salt of the antisense oligonucleotide according to the invention, or the conjugate according to the invention.

The invention provides a pharmaceutical composition comprising the antisense oligonucleotide of the invention or the conjugate of the invention and a pharmaceutically acceptable diluent, solvent, carrier, salt and/or adjuvant.

The invention provides an in vivo or in vitro method for inhibiting SCN9A expression in a target cell which is expressing SCN9A, said method comprising administering an oligonucleotide of the invention or the conjugate of the invention or the pharmaceutical salt or composition of the invention in an effective amount to said cell.

The invention provides an in vivo or in vitro method for inhibiting SCN9A and SCN10A expression in a target cell which is expressing SCN9A and SCN10A, said method comprising administering an oligonucleotide of the invention or the conjugate of the invention or the pharmaceutical salt or composition of the invention in an effective amount to said cell.

The invention provides a method for treating or preventing pain in a subject such as a human, who is suffering from or is likely to suffer pain, comprising administering a therapeutically or prophylactically effective amount of an antisense oligonucleotide of the invention or the conjugate of the invention or the pharmaceutical salt or composition of the invention, such as to prevent or alleviate the pain.

The invention provides for the antisense oligonucleotide of the invention or the conjugate of the invention or the pharmaceutical salt or composition of the invention for use in medicine.

The invention provides for the antisense oligonucleotide of the invention or the conjugate of the invention or the pharmaceutical salt or composition of the invention for use in the treatment or prevention or alleviation of pain The invention provides for the use of the antisense oligonucleotide of the invention or the conjugate of the invention or the pharmaceutical salt or composition of the invention, for the preparation of a medicament for the treatment, prevention or alleviation of pain.

In some embodiments the pain is chronic pain, neuropathic pain, inflammatory pain, spontaneous pain, or nociceptive pain.

In some embodiments the pain is caused by or associated with a disorder selected from the group consisting of diabetic neuropathies, cancer, cranial neuralgia, postherpetic neuralgia and post-surgical neuralgia; or In some embodiments the pain is caused by or associated with inherited erythromelalgia (EIM) or paroxysmal extreme pain disorder (PEPD) or trigeminal neuralgia; or In some embodiments the pain is neurophathic pain, chronic pain, but also general treatment of nociceptive pain (e.g. decompression of a nerve), or neuropathic pain (e.g. diabetic neuropathy), visceral pain, or mixed pain.

Definitions

Oligonucleotide

The term "oligonucleotide" as used herein is defined as it is generally understood by the skilled person as a molecule comprising two or more covalently linked nucleosides. Such covalently bound nucleosides may also be referred to as nucleic acid molecules or oligomers.

Oligonucleotides are commonly made in the laboratory by solid-phase chemical synthesis followed by purification and isolation. When referring to a sequence of the oligonucleotide, reference is made to the sequence or order of nucleobase moieties, or modifications thereof, of the covalently linked nucleotides or nucleosides. The oligonucleotide of the invention is man-made, and is chemically synthesized, and is typically purified or isolated. The oligonucleotide of the invention may comprise one or more modified nucleosides or nucleotides, such as 2' sugar modified nucleosides.

The oligonucleotide of the invention may be an antisense oligonucleotide, or may form part of a siRNA, such as the antisense strand of a siRNA targeting the target nucleic acid.

Advantageously, the oligonucleotide is an antisense oligonucleotide. Advantageous designs of antisense oligonucleotides for use in the antisense oligonucleotide of the invention, or contiguous nucleotide sequence thereof, include gapmers.

RNAi Agents

The terms 'iRNA," "RNAi agent," 'iRNA agent," and "RNA interference agent" as used interchangeably herein, refer to an agent that contains RNA nucleosides herein and which mediates the targeted cleavage of an RNA transcript via an RNA-induced silencing complex (RISC) pathway. iRNA directs the sequence-specific degradation of mRNA through a process as RNA interference (RNAi). The iRNA modulates. e g., inhibits, the expression of the target nucleic acid in a cell. e.g. a cell within a subject. such as a mammalian subject. RNAi agents includes single stranded RNAi agents and double stranded siRNAs, as well as short hairpin RNAs (shRNAs). The oligonucleotide of the invention or contiguous nucleotide sequence thereof may be in the form of a RNAi agent, or form part of a RNAi agent, such as an siRNA or shRNA. In some embodiments of the invention, the oligonucleotide of the invention or contiguous nucleotide sequence thereof is a RNAi agent, such as a siRNA.

siRNAs

The term siRNA refers to a small interfering ribonucleic acid RNAi agents, is a class of double-stranded RNA molecules, also known in the art as short interfering RNA or silencing RNA. siRNAs typically comprise a sense strand (also referred to as a passenger strand) and an antisense strand (also referred to as the guide strand), wherein each strand are of 17-30 nucleotides in length, typically 19-25 nucleosides in length, wherein the antisense strand is complementary, such as fully complementary, to the target nucleic acid (suitably a mature mRNA sequence), and the sense strand is complementary to the antisense strand so that the sense strand and antisense strand form a duplex or duplex region. siRNA strands may form a blunt ended duplex, or advantageously the sense and antisense strand 3' ends may form a 3' overhang of e.g. 1, 2 or 3 nucleosides. In some embodiments, both the sense strand and antisense strand have a 2nt 3' overhang. The duplex region may therefore be, for example 17-25 nucleotides in length, such as 21-23 nucleotide in length.

Once inside a cell the antisense strand is incorporated into the RISC complex which mediate target degradation or target inhibition of the target nucleic acid. siRNAs typically comprise modified nucleosides in addition to RNA nucleosides, or in some embodiments all of the nucleotides of an siRNA strand may be modified (the sense. 2' sugar modified nucleosides such as LNA (see WO2004083430, WO2007085485 for example), 2'fluoro, 2'-O-methyl or 2'-O-methoxyethyl may be incorporated into siRNAs. In some embodiments the passenger stand of the siRNA may be discontinuous (see WO2007107162 for example). The incorporation of thermally destabilizing nucleotides occurring at a seed region of the antisense strand of siRNAs have been reported as useful in reducing off-target activity of siRNAs (see WO18098328 for example).

In some embodiments, the dsRNA agent, such as the siRNA of the invention, comprises at least one modified nucleotide. In some embodiments, substantially all of the nucleotides of the sense strand comprise a modification; substantially all of the nucleotides of the antisense strand comprise a modification or substantially all of the nucleotides of the sense strand and substantially all of the nucleotides of the antisense strand comprise a modification. In yet other embodiments, all of the nucleotides of the sense strand comprise a modification; all of the nucleotides of the antisense strand comprise a modification; or all of the nucleotides of the sense strand and all of the nucleotides of the antisense strand comprise a modification.

In some embodiments, the modified nucleotides may be independently selected from the group consisting of a deoxy-nucleotide, a 3-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, an unlinked nucleitide, a tetrahydropyran modified nucleotide, a 1,5-anhydrohexitol modif'ied nucleotide, a cyclohexenyl modified nucleotide, a nucleotide comprising a phosphorothioate group, a nucleotide comprising a methylphosphonate group, a nucleotide comprising a 5*-phosphate, a nucleotide comprising a 5'-phosphate mimic, a glycol modified nucleotide, and a 2-O—(N-methylacetamide) modified nucleotide, and combinations thereof. Suitable the siRNA comprises a 5' phosphate group or a 5'-phosphate mimic at the 5' end of the antisense strand. In some embodiments the 5' end of the antisense strand is a RNA nucleoside.

In one embodiment, the dsRNA agent further comprises at least one phosphorothioate or methylphosphonate internucleotide linkage.

The phosphorothioaie or methylphosphonate internucleoiide linkage may be at the 3'-terminus one or both strand (e.g., the antisense strand; or the sense strand); or the phosphorothioaie or methylphosphonaie internucleoside linkage may be at the 5'-terminus of one or both strands (e.g., the antisense strand; or the sense strand); or the phosphorothioate or methylphosphonate internucleoside linkage may be at the both the 5'- and 3-terminus of one or both strands (e.g., the antisense strand; or the sense strand). In some embodiments the remaining internucleoside linkages are phosphodiester linkages.

The dsRNA agent may further comprise a ligand. In some embodiments, the ligand is conjugated to the 3' end of the sense strand.

For biological distribution, siRNAs may be conjugated to a targeting ligand, and/or be formulated into lipid nanoparticles, for example.

Other aspects of the invention relate to pharmaceutical compositions comprising these dsRNA, such as siRNA molecules suitable for therapeutic use, and methods of inhibiting the expression of the target gene by administering the dsRNA molecules such as siRNAs of the invention, e.g., for the treatment of various disease conditions as disclosed herein.

Antisense Oligonucleotides

The term "Antisense oligonucleotide" as used herein is defined as oligonucleotides capable of modulating expression of a target gene by hybridizing to a target nucleic acid, in particular to a contiguous sequence on a target nucleic acid. The antisense oligonucleotides are not essentially double stranded and are therefore not siRNAs or shRNAs. Preferably, the antisense oligonucleotides of the present invention are single stranded. It is understood that single stranded oligonucleotides of the present invention can form hairpins or intermolecular duplex structures (duplex between two molecules of the same oligonucleotide), as long as the degree of intra or inter self-complementarity is less than 50% across of the full length of the oligonucleotide.

Advantageously, the single stranded antisense oligonucleotide of the invention does not contain RNA nucleosides (2'-OH unmodified ribose).

Advantageously, the antisense oligonucleotide of the invention comprises one or more modified nucleosides or nucleotides, such as 2' sugar modified nucleosides. Furthermore, it is advantageous that the nucleosides which are not modified are DNA nucleosides. LNA antisense oligonucleotides are highly advantageous in the context of the antisense oligonucleotide of the invention.

Contiguous Nucleotide Sequence

The term "contiguous nucleotide sequence" refers to the region of the oligonucleotide which is complementary to the target nucleic acid. The term is used interchangeably herein with the term "contiguous nucleobase sequence" and the term "oligonucleotide motif sequence". In some embodiments all the nucleotides of the oligonucleotide constitute the contiguous nucleotide sequence. In some embodiments the oligonucleotide comprises the contiguous nucleotide sequence, such as a gapmer region (as illustrated herein by the formula F-G-F'), and may optionally comprise further nucleotide(s), for example a nucleotide linker region which may be used to attach a functional group to the contiguous nucleotide sequence. The nucleotide linker region may or may not be complementary to the target nucleic acid.

Nucleotides

Nucleotides are the building blocks of oligonucleotides and polynucleotides, and for the purposes of the present invention include both naturally occurring and non-naturally occurring nucleotides. In nature, nucleotides, such as DNA and RNA nucleotides comprise a ribose sugar moiety, a nucleobase moiety and one or more phosphate groups (which is absent in nucleosides). Nucleosides and nucleotides may also interchangeably be referred to as "units" or "monomers".

Modified Nucleoside

The term "modified nucleoside" or "nucleoside modification" as used herein refers to nucleosides modified as compared to the equivalent DNA or RNA nucleoside by the introduction of one or more modifications of the sugar moiety or the (nucleo)base moiety. In a preferred embodiment the modified nucleoside comprise a modified sugar moiety. The term modified nucleoside may also be used herein interchangeably with the term "nucleoside analogue" or modified "units" or modified "monomers". Nucleosides with an unmodified DNA or RNA sugar moiety are termed DNA or RNA nucleosides herein. Nucleosides with modifications in the base region of the DNA or RNA nucleoside are still generally termed DNA or RNA if they allow Watson Crick base pairing.

Modified Internucleoside Linkage

The term "modified internucleoside linkage" is defined as generally understood by the skilled person as linkages other than phosphodiester (PO) linkages, that covalently couples two nucleosides together. The oligonucleotides of the invention may therefore comprise modified internucleoside linkages. In some embodiments, the modified internucleoside linkage increases the nuclease resistance of the oligonucleotide compared to a phosphodiester linkage. For naturally occurring oligonucleotides, the internucleoside linkage includes phosphate groups creating a phosphodiester bond between adjacent nucleosides. Modified internucleoside linkages are particularly useful in stabilizing oligonucleotides for in vivo use, and may serve to protect against nuclease cleavage at regions of DNA or RNA nucleosides in the oligonucleotide of the invention, for example within the gap region G of a gapmer oligonucleotide, as well as in regions of modified nucleosides, such as region F and F'.

In an embodiment, the oligonucleotide comprises one or more internucleoside linkages modified from the natural phosphodiester In some embodiments at least 50% of the internucleoside linkages in the oligonucleotide, or contiguous nucleotide sequence thereof, are modified, such as at least 60%, such as at least 70%, such as at least 75%, such as at least 80% or such as at least 90% of the internucleoside linkages in the oligonucleotide, or contiguous nucleotide sequence thereof, are modified. In some embodiments all of the internucleoside linkages of the oligonucleotide, or contiguous nucleotide sequence thereof, are modified. It will be recognized that, in some embodiments the nucleosides which link the oligonucleotide of the invention to a non-nucleotide functional group, such as a conjugate, may be phosphodiester. In some embodiments all of the internucleoside linkages of the oligonucleotide, or contiguous nucleotide sequence thereof, are nuclease resistant internucleoside linkages.

With the oligonucleotides of the invention it is advantageous to use phosphorothioate internucleoside linkages.

Phosphorothioate internucleoside linkages are particularly useful due to nuclease resistance, beneficial pharmacokinetics and ease of manufacture. In some embodiments at least 50% of the internucleoside linkages in the oligonucleotide, or contiguous nucleotide sequence thereof, are phosphorothioate, such as at least 60%, such as at least 70%, such as at least 75%, such as at least 80% or such as at least 90% of the internucleoside linkages in the oligonucleotide, or contiguous nucleotide sequence thereof, are phosphorothioate. In some embodiments all of the internucleoside linkages of the oligonucleotide, or contiguous nucleotide sequence thereof, are phosphorothioate.

Advantageously, all the internucleoside linkages of the contiguous nucleotide sequence of the oligonucleotide are phosphorothioate, or all the internucleoside linkages of the oligonucleotide are phosphorothioate linkages.

It is recognized that, as disclosed in EP 2 742 135, antisense oligonucleotides may comprise other internucleoside linkages (other than phosphodiester and phosphorothioate), for example alkyl phosphonate/methyl phosphonate internucleoside, which according to EP 2 742 135 may for example be tolerated in an otherwise DNA phosphorothioate the gap region.

Nucleobase

The term nucleobase includes the purine (e.g. adenine and guanine) and pyrimidine (e.g. uracil, thymine and cytosine) moiety present in nucleosides and nucleotides which form hydrogen bonds in nucleic acid hybridization. In the context of the present invention the term nucleobase also encompasses modified nucleobases which may differ from naturally occurring nucleobases, but are functional during nucleic acid hybridization. In this context "nucleobase" refers to both naturally occurring nucleobases such as adenine, guanine, cytosine, thymidine, uracil, xanthine and hypoxanthine, as well as non-naturally occurring variants. Such variants are for example described in Hirao et al (2012) Accounts of Chemical Research vol 45 page 2055 and Bergstrom (2009) Current Protocols in Nucleic Acid Chemistry Suppl. 37 1.4.1.

In a some embodiments the nucleobase moiety is modified by changing the purine or pyrimidine into a modified purine or pyrimidine, such as substituted purine or substituted pyrimidine, such as a nucleobased selected from isocytosine, pseudoisocytosine, 5-methyl cytosine, 5-thiozolo-cytosine, 5-propynyl-cytosine, 5-propynyl-uracil, 5-bromouracil 5-thiazolo-uracil, 2-thio-uracil, 2'thio-thymine, inosine, diaminopurine, 6-aminopurine, 2-aminopurine, 2,6-diaminopurine and 2-chloro-6-aminopurine.

The nucleobase moieties may be indicated by the letter code for each corresponding nucleobase, e.g. A, T, G, C or U, wherein each letter may optionally include modified nucleobases of equivalent function. For example, in the exemplified oligonucleotides, the nucleobase moieties are selected from A, T, G, C, and 5-methyl cytosine. Optionally, for LNA gapmers, 5-methyl cytosine LNA nucleosides may be used.

Modified Oligonucleotide

The term modified oligonucleotide describes an oligonucleotide comprising one or more sugar-modified nucleosides and/or modified internucleoside linkages. The term chimeric" oligonucleotide is a term that has been used in the literature to describe oligonucleotides with modified nucleosides.

Complementarity

The term "complementarity" describes the capacity for Watson-Crick base-pairing of nucleosides/nucleotides. Watson-Crick base pairs are guanine (G)-cytosine (C) and adenine (A)-thymine (T)/uracil (U). It will be understood that oligonucleotides may comprise nucleosides with modified nucleobases, for example 5-methyl cytosine is often used in place of cytosine, and as such the term complementarity encompasses Watson Crick base-paring between non-modified and modified nucleobases (see for example Hirao et al (2012) Accounts of Chemical Research vol 45 page 2055 and Bergstrom (2009) Current Protocols in Nucleic Acid Chemistry Suppl. 37 1.4.1).

The term "% complementary" as used herein, refers to the proportion of nucleotides (in percent) of a contiguous nucleotide sequence in a nucleic acid molecule (e.g. oligonucleotide) which across the contiguous nucleotide sequence, are complementary to a reference sequence (e.g. a target sequence or sequence motif). The percentage of complementarity is thus calculated by counting the number of aligned nucleobases that are complementary (from Watson Crick base pair) between the two sequences (when aligned with the target sequence 5'-3' and the oligonucleotide sequence from 3'-5'), dividing that number by the total number of nucleotides in the oligonucleotide and multiplying by 100. In such a comparison a nucleobase/nucleotide which does not align (form a base pair) is termed a mismatch. Insertions and deletions are not allowed in the calculation of % complementarity of a contiguous nucleotide sequence. It will be understood that in determining complementarity, chemical modifications of the nucleobases are disregarded as long as the functional capacity of the nucleobase to form Watson Crick base pairing is retained (e.g. 5'-methyl cytosine is considered identical to a cytosine for the purpose of calculating % identity).

The term "fully complementary", refers to 100% complementarity.

Identity

The term "Identity" as used herein, refers to the proportion of nucleotides (expressed in percent) of a contiguous nucleotide sequence in a nucleic acid molecule (e.g. oligonucleotide) which across the contiguous nucleotide sequence, are identical to a reference sequence (e.g. a sequence motif). The percentage of identity is thus calculated by counting the number of aligned nucleobases that are identical (a Match) between two sequences (in the contiguous nucleotide sequence of the compound of the invention and in the reference sequence), dividing that number by the total number of nucleotides in the oligonucleotide and multiplying by 100. Therefore, Percentage of Identity= (Matches×100)/Length of aligned region (e.g. the contiguous nucleotide sequence). Insertions and deletions are not allowed in the calculation the percentage of identity of a contiguous nucleotide sequence. It will be understood that in determining identity, chemical modifications of the nucleobases are disregarded as long as the functional capacity of the nucleobase to form Watson Crick base pairing is retained (e.g. 5-methyl cytosine is considered identical to a cytosine for the purpose of calculating % identity).

Hybridization

The term "hybridizing" or "hybridizes" as used herein is to be understood as two nucleic acid strands (e.g. an oligonucleotide and a target nucleic acid) forming hydrogen bonds between base pairs on opposite strands thereby forming a duplex. The affinity of the binding between two nucleic acid strands is the strength of the hybridization. It is often described in terms of the melting temperature ($T_m$) defined as the temperature at which half of the oligonucleotides are duplexed with the target nucleic acid. At physiological conditions $T_m$ is not strictly proportional to the affinity (Mergny and Lacroix, 2003, *Oligonucleotides* 13:515-537). The standard state Gibbs free energy $\Delta G°$ is a more accurate representation of binding affinity and is related to the dissociation constant ($K_d$) of the reaction by $\Delta G°=-RTln(K_d)$, where R is the gas constant and T is the absolute temperature. Therefore, a very low $\Delta G°$ of the reaction between an oligonucleotide and the target nucleic acid reflects a strong hybridization between the oligonucleotide and target nucleic acid. $\Delta G°$ is the energy associated with a reaction where aqueous concentrations are 1M, the pH is 7, and the temperature is 37° C. The hybridization of oligonucleotides to a target nucleic acid is a spontaneous reaction and for spontaneous reactions $\Delta G°$ is less than zero. $\Delta G°$ can be measured experimentally, for example, by use of the isothermal titration calorimetry (ITC) method as described in Hansen et al., 1965, *Chem. Comm.* 36-38 and Holdgate et al., 2005, Drug Discov Today. The skilled person will know that commercial equipment is available for $\Delta G°$ measurements. $\Delta G°$ can also be estimated numerically by using the nearest neighbor model as described by SantaLucia, 1998, *Proc Natl Acad Sci USA.* 95: 1460-1465 using appropriately derived thermodynamic parameters described by Sugimoto et al., 1995, *Biochemistry* 34:11211-11216 and McTigue et al., 2004, *Biochemistry* 43:5388-5405. In order to have the possibility of modulating its intended nucleic acid target by hybridization, oligonucleotides of the present invention hybridize to a target nucleic acid with estimated $\Delta G°$ values below -10 kcal for oligonucleotides that are 10-30 nucleotides in length. In some embodiments the degree or strength of hybridization is measured by the standard state Gibbs free energy $\Delta G°$. The oligonucleotides may hybridize to a target nucleic acid with estimated $\Delta G°$ values below the range of -10 kcal, such as below -15 kcal, such as below -20 kcal and such as below -25 kcal for oligonucleotides that are 8-30 nucleotides in length. In some embodiments the oligonucleotides hybridize to a target nucleic acid with an estimated $\Delta G°$ value of -10 to -60 kcal, such as -12 to -40, such as from -15 to -30 kcal or -16 to -27 kcal such as -18 to -25 kcal.

Target Nucleic Acid

According to the present invention, the target nucleic acid is a nucleic acid which encodes mammalian or human voltage-gated sodium ion channel and may for example be a gene, a RNA, a mRNA, and pre-mRNA, a mature mRNA or a cDNA sequence.

The target may therefore be referred to as a target nucleic acid. The oligonucleotide of the invention may for example target exon regions of a mammalian such as a human SCN9A target nucleic acid, or may for example target intron region of a mammalian such as a human SCN9A pre-mRNA (see Table 1).

TABLE 1

Human SCN9A Exons and Introns — Based upon SCN9A transcript SCN9A-201:

| Exon Number | Position on SEQ ID NO 1 | | Intron Number | Position on SEQ ID NO 1 | |
|---|---|---|---|---|---|
| | Exon start | Exon end | | Intron Start | Intron End |
| E1 | 101 | 298 | I1 | 298 | 64196 |
| E2 | 64196 | 64503 | I2 | 64503 | 68928 |
| E3 | 68928 | 69046 | I3 | 69046 | 69403 |
| E4 | 69403 | 69492 | I4 | 69492 | 70082 |
| E5 | 70082 | 70210 | I5 | 70210 | 71673 |
| E6 | 71673 | 71764 | I6 | 71764 | 72700 |
| E7 | 72700 | 72912 | I7 | 72912 | 81340 |
| E8 | 81340 | 81403 | I8 | 81403 | 82630 |
| E9 | 82630 | 82771 | I9 | 82771 | 87359 |
| E10 | 87359 | 87565 | I10 | 87565 | 89379 |
| E11 | 89379 | 89666 | I11 | 89666 | 91178 |
| E12 | 91178 | 91549 | I12 | 91549 | 94194 |
| E13 | 94194 | 94323 | I13 | 94323 | 95407 |
| E14 | 95407 | 95645 | I14 | 95645 | 97689 |
| E15 | 97689 | 97862 | I15 | 97862 | 98663 |
| E16 | 98663 | 99019 | I16 | 99019 | 103127 |
| E17 | 103127 | 103603 | I17 | 103603 | 124117 |
| E18 | 124117 | 124237 | I18 | 124237 | 133346 |
| E19 | 133346 | 133500 | I19 | 133500 | 137735 |
| E20 | 137735 | 137908 | I20 | 137908 | 142540 |
| E21 | 142540 | 142662 | I21 | 142662 | 147030 |
| E22 | 147030 | 147311 | I22 | 147311 | 148279 |
| E23 | 148279 | 148332 | I23 | 148332 | 149298 |
| E24 | 149298 | 149435 | I24 | 149435 | 171538 |
| E25 | 171538 | 171642 | I25 | 171642 | 171777 |
| E26 | 171777 | 172047 | I26 | 172047 | 176138 |
| E27 | 176138 | 180813 | | | |

According to ENSEMBL, there are at least 13 human SCN9A transcript variants—the target nucleic acid may therefore be a SCN9A transcript (mRNA) selected from the group consisting of SEQ ID NOs 4-16:

| Tname | Strand | Tstart (chr2) | Tend (chr2) | rel_start (SEQ ID NO1) | rel_end (SEQ ID NO1) | SEQ ID NO |
|---|---|---|---|---|---|---|
| SCN9A-203 | -1 | 166195185 | 166375993 | 9 | 180817 | 4 |
| SCN9A-201 | -1 | 166195189 | 166375901 | 101 | 180813 | 5 |
| SCN9A-212 | -1 | 166197462 | 166375901 | 101 | 178540 | 6 |
| SCN9A-213 | -1 | 166198299 | 166205239 | 170763 | 177703 | 7 |
| SCN9A-209 | -1 | 166198411 | 166311756 | 64246 | 177591 | 8 |
| SCN9A-207 | -1 | 166198611 | 166375914 | 88 | 177391 | 9 |
| SCN9A-202 | -1 | 166198672 | 166311756 | 64246 | 177330 | 10 |
| SCN9A-208 | -1 | 166242624 | 166272749 | 103253 | 133378 | 11 |
| SCN9A-210 | -1 | 166276417 | 166278313 | 97689 | 99585 | 12 |
| SCN9A-205 | -1 | 166277716 | 166375969 | 33 | 98286 | 13 |
| SCN9A-204 | -1 | 166288615 | 166375944 | 58 | 87387 | 14 |
| SCN9A-211 | -1 | 166301174 | 166304089 | 71913 | 74828 | 15 |
| SCN9A-206 | -1 | 166302063 | 166376001 | 1 | 73939 | 16 |

Suitably, the target nucleic acid may encode an $Na_v1.7$ protein, in particular mammalian $Na_v1.7$, such as human $Na_v1.7$ (See for example tables 2 and 3) which provides the mRNA and pre-mRNA sequences for human, monkey, and pig $Na_v1.7$ encoding transcripts.

In some embodiments, the target nucleic acid is selected from the group consisting of SEQ ID NO: 1, 2, and 3 or naturally occurring variants thereof (e.g. sequences encoding a mammalian $Na_v1.7$ protein). In some embodiments the target nucleic acid is a transcript variant of SCN9A, such as a transcript variant selected from the group consisting of SEQ ID NOs 4-16.

If employing the oligonucleotide of the invention in research or diagnostics the target nucleic acid may be a cDNA or a synthetic nucleic acid derived from DNA or RNA.

For in vivo or in vitro application, the oligonucleotide of the invention is typically capable of inhibiting the expression of the target nucleic acid, for example the SCN9A target nucleic acid, in a cell which is expressing the SCN9A target nucleic acid target nucleic acid. The contiguous sequence of nucleobases of the oligonucleotide of the invention is complementary, such as fully complementary to the SCN9A target nucleic acid, as measured across the length of the oligonucleotide optionally excluding nucleotide based linker regions which may link the oligonucleotide to an optional functional group such as a conjugate, or other non-complementary terminal nucleotides (e.g. region D' or D"). The target nucleic acid may, in some embodiments, be a RNA or DNA, such as a messenger RNA, such as a mature mRNA or a pre-mRNA.

In some embodiments the target nucleic acid is a RNA or DNA which encodes mammalian Nav1.7 protein, such as human SCN9A target, e.g. the human SCN9A pre-mRNA sequence, such as that disclosed as SEQ ID NO 1, or human SCN9A mature mRNA, such as that disclosed as SEQ ID NO 2. Further information on exemplary target nucleic acids is provided in tables 2 and 3.

target nucleic acid with a nucleobase sequence that is complementary to the contiguous nucleotide sequence of the oligonucleotide of the invention. This region of the target nucleic acid may interchangeably be referred to as the target nucleotide sequence, target sequence or target region. In some embodiments the target sequence is longer than the complementary sequence of a single oligonucleotide, and may, for example represent a preferred region of the target nucleic acid which may be targeted by several oligonucleotides of the invention.

The oligonucleotide of the invention comprises a contiguous nucleotide sequence which is complementary to or hybridizes to the target nucleic acid, such as a target sequence described herein. Advantageously, the contiguous nucleotide sequence of the oligonucleotide of the invention is 100% complementary to the target nucleic acid across at least 10 contiguous bases, more advantageously across at least 12 contiguous bases, more advantageously, the contiguous nucleotide sequence of the oligonucleotide of the invention is 100% complementary to the target nucleic acid across the length of the contiguous nucleotide sequence.

According to the invention, the contiguous nucleotide sequence is between 10 to 30 nucleotides, such as 12 to 30, such as 14 to 20, such as 15 to 18 contiguous nucleotides.

The invention also provides target sequences (sub-sequences) present in SEQ ID NO 1 which may be targeted by

TABLE 2

Genome and assembly information for SCN9A across species.

| Species | Chr. | Strand | Genomic coordinates | | | NCBI reference sequence* accession number for mRNA |
| --- | --- | --- | --- | --- | --- | --- |
| | | | Start | End | Assembly | |
| Human | 2 | Rev | 166195185 | 166376001 | GRCh38.p12 | ENSG00000169432 |
| Cynomolgus monkey | 12 | Rev | 55071072 | 55190227 | Macaca_fascicularis_5.0 | ENSMFAG00000034634 |
| Pig | 15 | Rev | 72745114 | 72912407 | Sscrofa11.1 | ENSSSCG00000015913 |
| Rat | 3 | Rev | 52583951 | 52664209 | Rnor_6.0 | ENSRNOG00000006639 |
| Mouse | 2 | Rev | 66480080 | 66634962 | GRCm38.p6 | ENSMUSG00000075316 |

Fwd = forward strand. The genome coordinates provide the pre-mRNA sequence (genomic sequence). The NCBI reference provides the mRNA sequence (cDNA sequence).
*The National Center for Biotechnology Information reference sequence database is a comprehensive, integrated, non-redundant, well-annotated set of reference sequences including genomic, transcript, and protein. It is hosted at www.ncbi.nlm.nih.gov/refseq.

TABLE 3

Exemplary SCN9A target nucleic acid sequences.

| Species | RNA type | SEQ ID NO |
| --- | --- | --- |
| Human | premRNA | 1 |
| Cynomologous monkey | premRNA | 2 |
| Pig | premRNA | 3 |

In some embodiments the target nucleic acid is the human SCN10A premRNA transcript, for example a SCN10A target nucleic acid selected from the group consisting of NCBI Genbank references: NM_006514.3 GI: 693073569, NM_001293307.2 GI: 693072645 &NM_001293306.2 GI: 693064349—hereby incorporated by reference.

Target Sequence

The term "target sequence" as used herein refers to a sequence of nucleotides present in the target nucleic acid which comprises the nucleobase sequence which is complementary to the oligonucleotide of the invention. In some embodiments, the target sequence consists of a region on the the oligonucleotides of the invention. The oligonucleotide of the oligonucleotide of the invention may therefore comprise of a contiguous nucleotide sequence which is at least 90% complementary, advantageously fully complementary to a target sequence (as measured across the length of the contiguous nucleotide sequence).

In some advantageous embodiments of the invention the oligonucleotide of the invention targets both Nav1.7 and Nav1.8 target sequences. A reference human Nav1.8 pre-mRNA sequence is provided herein as SEQ ID NO 651 (see also above SCN10A premRNA transcript information). Compounds which target both Nav1.7 and Nav1.8 are suitably capable of inhibiting the expression of both SCN9A and SCN10A in a cell which is expressing both SCN9A and SCN10A.

Target Sequence List 1

In some embodiments the target sequence is a region of SEQ ID NO 1 selected from the group consisting of 617-630; 852-868; 963-976; 1039-1053; 1070-1085; 1375-1388; 1512-1526; 1689-1702; 2673-2691; 3189-3202; 3275-3290; 3900-3921; 4132-4145; 4795-4808; 4941-4955; 5165-5182; 5359-5372; 5430-5444; 5453-5529; 5544-5588; 5608-5675;

5695-5717; 5719-5732; 5765-5809; 5896-5909; 6019-6032; 6066-6085; 6151-6164; 6167-6180; 6357-6370; 6629-6657; 6859-6872; 6959-6972; 6998-7019; 7032-7056; 7060-7079; 7085-7098; 7102-7129; 7131-7152; 7156-7185; 7233-7247; 7254-7271; 7273-7295; 7297-7317; 7381-7412; 7456-7499; 7502-7522; 7527-7561; 7575-7592; 8087-8100; 8438-8454; 8475-8490; 8502-8515; 8531-8572; 8592-8610; 8612-8635; 8653-8677; 8700-8715; 8726-8741; 9093-9106; 9333-9346; 9386-9399; 9446-9463; 9468-9481; 9535-9550; 9592-9606; 10627-10643; 10767-10780; 11442-11458; 11489-11502; 11712-11725; 11797-11810; 11822-11843; 11879-11901; 12017-12030; 12302-12315; 13542-13555; 13740-13754; 14186-14199; 14451-14464; 15059-15072; 15354-15367; 15747-15789; 15800-15824; 15851-15864; 15869-15911; 15931-15959; 15987-16005; 16019-16037; 16039-16053; 16066-16079; 16136-16158; 16245-16258; 16304-16317; 16486-16499; 16680-16693; 16753-16766; 16962-16975; 16983-16998; 17032-17045; 17146-17167; 17536-17550; 17574-17587; 17634-17647; 17660-17676; 17696-17711; 17713-17739; 17741-17755; 17758-17783; 17805-17827; 17830-17846; 17851-17875; 17878-17893; 17905-17967; 18802-18816; 18829-18843; 18857-18870; 18991-19005; 19024-19037; 19475-19488; 19943-19967; 19969-19984; 19992-20043; 20045-20072; 20090-20150; 20153-20183; 20196-20213; 20298-20312; 20422-20436; 20481-20494; 20739-20752; 20774-20790; 20808-20826; 20830-20843; 20848-20866; 20883-20905; 20928-20950; 21042-21055; 21084-21097; 21680-21693; 21781-21805; 21952-21965; 22150-22163; 22764-22782; 22797-22810; 22823-22836; 22880-22909; 22914-22927; 22978-22992; 23917-23930; 25991-26006; 26018-26031; 26047-26071; 26091-26113; 26123-26160; 26171-26208; 26270-26309; 26404-26418; 26446-26460; 26621-26634; 26688-26701; 26842-26876; 26961-26978; 27014-27027; 27034-27049; 27126-27154; 27744-27759; 27792-27805; 28740-28754; 29019-29033; 29068-29081; 30376-30389; 30808-30821; 30935-30948; 31683-31696; 32174-32204; 32260-32273; 32313-32326; 32334-32360; 32596-32609; 32722-32735; 33245-33258; 33261-33274; 33376-33389; 33925-33938; 34197-34212; 35003-35016; 35106-35126; 35150-35169; 35388-35402; 35517-35530; 35626-35639; 35894-35908; 36515-36530; 36742-36755; 36832-36845; 37259-37272; 37648-37673; 37819-37832; 38077-38093; 38215-38228; 39849-39862; 40022-40035; 41312-41326; 41753-41766; 42181-42198; 42208-42231; 42583-42596; 42939-42957; 43053-43092; 43465-43478; 44750-44763; 46413-46426; 46577-46590; 46944-46957; 46972-46985; 47548-47566; 47670-47685; 47688-47709; 47728-47745; 48575-48597; 48600-48614; 48616-48630; 48713-48730; 48922-48946; 49929-49942; 50292-50308; 50709-50722; 50875-50888; 51576-51589; 51695-51720; 51734-51753; 51755-51776; 51796-51830; 51842-51856; 52867-52883; 53956-53969; 53975-53988; 54188-54213; 54393-54406; 54463-54487; 54707-54723; 55116-55129; 55840-55855; 55961-55975; 56298-56311; 56785-56798; 57416-57429; 58378-58391; 58394-58410; 58626-58639; 58670-58684; 58837-58851; 59251-59264; 59294-59320; 59328-59351; 59353-59417; 59419-59434; 59471-59490; 59505-59531; 59566-59585; 59722-59744; 59949-59962; 60076-60092; 60094-60110; 60120-60184; 60210-60266; 60281-60303; 60306-60368; 60370-60413; 60415-60444; 60458-60474; 60476-60565; 60572-60614; 60620-60633; 60635-60655; 60678-60692; 60731-60750; 60762-60784; 60786-60802; 60805-60822; 60824-60839; 60847-60863; 60865-60882; 60884-60932; 60934-60980; 61025-61065; 61067-61081; 61122-61144; 61154-61169; 61171-61191; 61193-61209; 61221-61258; 61260-61288; 61298-61315; 61325-61384; 61416-61443; 61445-61460; 61469-61500; 61505-61544; 61562-61612; 61622-61651; 61661-61675; 61677-61691; 61693-61710; 61712-61738; 61741-61773; 61775-61789; 61791-61837; 61839-61873; 61875-61888; 61897-61935; 61937-61950; 61958-61999; 62003-62019; 62021-62041; 62043-62064; 62085-62104; 62135-62160; 62162-62184; 62186-62204; 62220-62233; 62235-62260; 62267-62281; 62289-62305; 62307-62361; 62364-62412; 62416-62431; 62438-62464; 62480-62496; 62540-62562; 62569-62631; 62649-62698; 62730-62752; 62762-62788; 62798-62837; 62855-62868; 62875-62888; 62890-62903; 62910-62923; 62925-62940; 62957-62972; 62980-63008; 63013-63046; 63050-63111; 63135-63151; 63166-63238; 63266-63279; 63290-63344; 63346-63390; 63392-63409; 63411-63425; 63427-63451; 63465-63537; 63575-63592; 63594-63618; 63624-63643; 63676-63700; 63719-63758; 63775-63804; 63820-63861; 63863-63888; 63890-63906; 63908-63934; 63942-63956; 63975-64000; 64002-64015; 64035-64052; 64054-64072; 64078-64095; 64101-64132; 64144-64174; 64176-64286; 64288-64367; 64378-64397; 64399-64476; 64478-64502; 64504-64529; 64542-64597; 64610-64684; 64686-64703; 64718-64751; 64756-64769; 64920-64944; 65067-65112; 65129-65144; 65146-65169; 65193-65223; 65240-65268; 65349-65395; 65439-65479; 65517-65531; 65533-65580; 65593-65611; 65622-65640; 65682-65705; 65714-65758; 65805-65823; 65842-65875; 65880-65902; 65907-65943; 65945-65983; 65985-66004; 66006-66019; 66074-66091; 66152-66169; 66171-66195; 66246-66264; 66266-66282; 66315-66356; 66366-66379; 66381-66397; 66424-66438; 66440-66466; 66468-66495; 66510-66569; 66571-66589; 66591-66643; 66645-66673; 66681-66715; 66723-66745; 66750-66770; 66784-66806; 66818-66836; 66838-66888; 66898-66929; 66944-66966; 66991-67037; 67055-67083; 67091-67113; 67126-67169; 67186-67203; 67208-67256; 67258-67294; 67310-67333; 67336-67366; 67368-67436; 67444-67457; 67490-67518; 67535-67548; 67558-67575; 67582-67604; 67606-67629; 67631-67644; 67671-67721; 67729-67775; 67777-67799; 67801-67840; 67842-67879; 67941-67954; 67971-67992; 68012-68030; 68039-68058; 68083-68097; 68125-68172; 68199-68292; 68297-68310; 68312-68332; 68334-68354; 68356-68427; 68436-68459; 68461-68478; 68480-68493; 68495-68541; 68544-68566; 68568-68582; 68584-68622; 68625-68642; 68648-68662; 68665-68683; 68692-68723; 68761-68776; 68781-68807; 68809-68834; 68836-68909; 68922-69056; 69058-69076; 69100-69123; 69125-69169; 69171-69200; 69202-69219; 69221-69247; 69249-69311; 69314-69365; 69384-69461; 69463-69498; 69500-69526; 69528-69558; 69580-69596; 69598-69626; 69660-69680; 69695-69730; 69743-69780; 69800-69829; 69843-69879; 69881-69902; 69916-69935; 69937-69956; 69994-70011; 70022-70234; 70243-70257; 70259-70277; 70341-70401; 70403-70422; 70437-70474; 70478-70528; 70530-70576; 70593-70607; 70609-70626; 70628-70690; 70708-70740; 70742-70768; 70770-70785; 70802-70817; 70830-70864; 70877-70902; 70955-70996; 70998-71036; 71053-71074; 71093-71149; 71192-71212; 71214-71244; 71246-71262; 71264-71318; 71334-71377; 71389-71406; 71442-71500; 71502-71530; 71546-71577; 71584-71634; 71655-71847; 71849-72043; 72047-72099; 72101-72131; 72140-72190; 72194-72207; 72218-72232; 72234-72259; 72261-72349; 72351-72370; 72372-72386; 72388-72415; 72430-72460; 72462-72476; 72518-72542; 72550-72584; 72586-72619; 72621-72639; 72652-72674; 72682-72715; 72717-72751; 72753-72836; 72854-72925; 72938-72954; 72956-72975; 72981-73018; 73068-73121; 73143-73166; 73169-73229; 73233-73260; 73262-73280; 73316-73334; 73345-73358; 73379-73403; 73413-73462; 73468-73492;

73500-73543; 73567-73600; 73602-73630; 73632-73646; 73648-73718; 73725-73743; 73749-73797; 73820-73846; 73860-73885; 73897-73948; 73951-74003; 74025-74038; 74046-74069; 74077-74098; 74105-74157; 74176-74201; 74228-74268; 74280-74298; 74303-74332; 74367-74384; 74395-74415; 74429-74465; 74480-74498; 74524-74538; 74540-74568; 74604-74659; 74668-74711; 74723-74737; 74750-74777; 74793-74819; 74828-74865; 74900-74940; 74970-75002; 75006-75020; 75022-75040; 75042-75058; 75115-75130; 75166-75204; 75206-75234; 75243-75256; 75259-75287; 75319-75345; 75358-75378; 75396-75426; 75428-75448; 75460-75482; 75484-75646; 75681-75708; 75710-75726; 75744-75760; 75762-75785; 75801-75822; 75831-75853; 75856-75878; 75880-75923; 75938-75975; 75982-76000; 76003-76017; 76023-76069; 76071-76124; 76126-76142; 76144-76240; 76258-76302; 76321-76337; 76367-76387; 76392-76460; 76462-76512; 76514-76540; 76545-76564; 76566-76588; 76590-76643; 76665-76691; 76693-76740; 76746-76786; 76811-76828; 76830-76851; 76853-76906; 76927-76941; 76949-77035; 77037-77066; 77077-77100; 77120-77147; 77157-77178; 77194-77244; 77246-77259; 77282-77314; 77319-77358; 77360-77381; 77425-77487; 77504-77518; 77531-77576; 77578-77602; 77604-77618; 77627-77661; 77663-77702; 77704-77722; 77724-77766; 77787-77800; 77810-77824; 77826-77839; 77855-77885; 77897-77932; 77962-77996; 78030-78058; 78074-78103; 78105-78129; 78153-78190; 78197-78214; 78216-78238; 78240-78255; 78292-78310; 78312-78325; 78327-78346; 78366-78393; 78401-78415; 78435-78459; 78507-78530; 78532-78565; 78567-78604; 78606-78653; 78672-78708; 78710-78751; 78772-78826; 78852-78865; 78867-78888; 78890-78909; 78911-78953; 78955-78986; 78989-79039; 79041-79056; 79058-79075; 79088-79128; 79130-79149; 79187-79265; 79286-79312; 79314-79334; 79337-79379; 79382-79401; 79414-79430; 79432-79450; 79463-79497; 79499-79530; 79532-79596; 79603-79653; 79668-79684; 79695-79710; 79712-79734; 79736-79818; 79820-79954; 79956-79972; 79986-79999; 80009-80043; 80062-80086; 80099-80165; 80171-80184; 80198-80246; 80248-80277; 80285-80299; 80311-80335; 80359-80374; 80394-80408; 80410-80442; 80444-80461; 80463-80482; 80484-80525; 80527-80553; 80555-80599; 80615-80642; 80644-80659; 80674-80709; 80711-80725; 80737-80791; 80819-80841; 80855-80874; 80889-80905; 80921-80953; 80977-81008; 81010-81049; 81051-81096; 81098-81120; 81140-81154; 81168-81206; 81231-81244; 81254-81267; 81287-81300; 81308-81323; 81325-81343; 81345-81358; 81360-81448; 81450-81463; 81465-81517; 81527-81542; 81544-81601; 81612-81625; 81636-81675; 81678-81697; 81706-81721; 81740-81806; 81819-81832; 81834-81853; 81861-81895; 81909-81945; 81965-81983; 81999-82013; 82015-82029; 82031-82063; 82072-82134; 82139-82155; 82157-82182; 82192-82210; 82212-82227; 82238-82253; 82286-82306; 82308-82325; 82337-82353; 82355-82401; 82403-82452; 82454-82514; 82526-82551; 82553-82566; 82571-82618; 82634-82654; 82656-82761; 82763-82777; 82779-82818; 82820-82833; 82852-82895; 82897-82917; 82951-82969; 82971-82996; 83001-83015; 83017-83042; 83055-83083; 83085-83098; 83100-83176; 83202-83224; 83226-83241; 83250-83263; 83270-83287; 83321-83341; 83343-83358; 83388-83402; 83404-83421; 83468-83499; 83512-83531; 83533-83564; 83596-83631; 83633-83688; 83702-83743; 83745-83775; 83781-83800; 83811-83939; 83941-83968; 83971-84013; 84019-84040; 84042-84145; 84150-84166; 84168-84256; 84258-84286; 84304-84323; 84325-84349; 84351-84390; 84392-84461; 84477-84518; 84532-84580; 84608-84628; 84630-84677; 84693-84721; 84740-84771; 84773-84807; 84809-84822; 84824-84873; 84887-84920; 84922-84944; 84955-85003; 85005-85018; 85020-85043; 85045-85075; 85095-85113; 85147-85239; 85242-85277; 85279-85297; 85304-85334; 85336-85350; 85352-85400; 85442-85495; 85497-85510; 85523-85580; 85586-85622; 85624-85645; 85647-85664; 85672-85692; 85694-85743; 85745-85769; 85771-85815; 85817-85869; 85871-85900; 85922-85950; 85952-85970; 85972-85997; 86022-86038; 86047-86060; 86087-86107; 86109-86175; 86195-86210; 86212-86246; 86248-86269; 86283-86324; 86340-86356; 86358-86394; 86396-86421; 86430-86570; 86572-86588; 86629-86654; 86669-86693; 86695-86708; 86711-86726; 86750-86789; 86797-86825; 86827-86853; 86858-86879; 86885-86902; 86905-86937; 86950-86972; 86984-87015; 87027-87068; 87070-87143; 87145-87185; 87187-87229; 87232-87266; 87292-87318; 87327-87381; 87383-87442; 87444-87462; 87464-87537; 87539-87593; 87595-87611; 87613-87631; 87644-87674; 87676-87691; 87693-87712; 87748-87775; 87777-87799; 87801-87843; 87845-87858; 87877-87908; 87917-87932; 87945-87971; 88019-88059; 88067-88083; 88085-88107; 88124-88137; 88144-88158; 88164-88212; 88214-88232; 88268-88290; 88297-88334; 88336-88356; 88370-88391; 88393-88415; 88417-88437; 88448-88485; 88492-88513; 88515-88560; 88574-88606; 88620-88658; 88682-88696; 88698-88744; 88746-88775; 88777-88834; 88852-88878; 88880-88894; 88906-88935; 88942-89030; 89032-89051; 89075-89096; 89098-89148; 89168-89200; 89205-89231; 89233-89281; 89283-89296; 89298-89383; 89397-89539; 89541-89561; 89588-89617; 89619-89638; 89640-89661; 89663-89678; 89711-89742; 89748-89765; 89767-89794; 89813-89834; 89848-89862; 89864-89885; 89893-89914; 89923-89953; 89955-89982; 90070-90095; 90097-90147; 90153-90166; 90171-90207; 90209-90225; 90236-90255; 90262-90275; 90289-90323; 90330-90349; 90390-90406; 90408-90426; 90437-90509; 90511-90536; 90542-90598; 90607-90653; 90673-90689; 90691-90706; 90732-90748; 90750-90775; 90780-90794; 90811-90834; 90847-90868; 90877-90909; 90911-90926; 90928-90948; 90950-90984; 91026-91042; 91055-91123; 91135-91151; 91164-91252; 91254-91407; 91409-91604; 91626-91673; 91675-91694; 91698-91803; 91805-91823; 91831-91849; 91865-91996; 92026-92043; 92061-92093; 92150-92167; 92187-92215; 92225-92243; 92265-92287; 92289-92308; 92318-92353; 92355-92379; 92382-92406; 92417-92522; 92528-92546; 92548-92600; 92622-92700; 92703-92731; 92747-92780; 92790-92803; 92805-92818; 92832-92851; 92861-92901; 92910-92947; 92960-92986; 92997-93048; 93056-93077; 93093-93117; 93124-93143; 93154-93220; 93226-93246; 93262-93276; 93285-93313; 93315-93329; 93332-93378; 93402-93448; 93455-93480; 93496-93525; 93549-93579; 93593-93632; 93634-93650; 93663-93685; 93687-93704; 93718-93732; 93743-93770; 93772-93793; 93797-93814; 93816-93834; 93845-93863; 93879-93899; 93903-93927; 93938-93979; 93981-94028; 94038-94059; 94061-94087; 94089-94109; 94111-94172; 94185-94198; 94200-94267; 94269-94343; 94351-94395; 94437-94469; 94483-94507; 94529-94562; 94578-94616; 94631-94666; 94686-94713; 94716-94768; 94770-94796; 94798-94852; 94892-94921; 94923-94983; 94986-95015; 95029-95086; 95088-95185; 95187-95206; 95208-95228; 95230-95250; 95279-95306; 95314-95329; 95336-95363; 95367-95392; 95394-95596; 95598-95666; 95670-95685; 95687-95700; 95702-95731; 95767-95781; 95794-95810; 95843-95902; 95904-95949; 95953-95977; 95993-96014; 96016-96041; 96043-96073; 96080-96115; 96117-96138; 96155-96170; 96172-96186; 96189-96205; 96213-96230; 96267-96313; 96320-96335; 96338-96403;

96442-96462; 96469-96500; 96502-96517; 96531-96558; 96560-96580; 96591-96606; 96608-96623; 96625-96646; 96648-96688; 96690-96715; 96718-96774; 96784-96855; 96863-96888; 96895-96972; 96974-97006; 97011-97046; 97048-97177; 97179-97193; 97195-97219; 97221-97288; 97298-97320; 97322-97382; 97384-97444; 97452-97501; 97553-97643; 97648-97675; 97677-97835; 97837-97905; 97913-97929; 97944-97981; 97983-98025; 98035-98056; 98058-98086; 98094-98137; 98152-98203; 98205-98225; 98229-98268; 98270-98288; 98290-98314; 98352-98401; 98416-98442; 98444-98457; 98511-98533; 98543-98575; 98594-98619; 98639-98730; 98732-98751; 98753-98856; 98858-98958; 98960-99003; 99005-99037; 99041-99108; 99136-99155; 99157-99179; 99213-99261; 99292-99320; 99330-99415; 99417-99464; 99477-99490; 99492-99518; 99520-99580; 99582-99601; 99625-99643; 99649-99664; 99675-99691; 99711-99753; 99755-99776; 99797-99818; 99838-99860; 99868-99903; 99905-99946; 99961-100010; 100012-100063; 100065-100092; 100109-100128; 100143-100196; 100204-100227; 100233-100246; 100248-100271; 100302-100335; 100337-100361; 100370-100430; 100433-100462; 100484-100501; 100511-100550; 100552-100588; 100598-100621; 100623-100649; 100653-100669; 100671-100685; 100720-100734; 100748-100785; 100787-100858; 100866-100881; 100887-100918; 100920-100962; 100964-100983; 100993-101015; 101041-101055; 101057-101075; 101117-101158; 101184-101218; 101222-101250; 101262-101275; 101277-101305; 101308-101326; 101336-101349; 101351-101374; 101389-101446; 101448-101508; 101531-101550; 101555-101579; 101597-101617; 101635-101688; 101690-101713; 101715-101767; 101769-101841; 101880-101906; 101908-101942; 101945-102000; 102007-102026; 102028-102045; 102047-102063; 102065-102083; 102104-102118; 102122-102153; 102155-102185; 102195-102253; 102255-102270; 102272-102346; 102360-102396; 102412-102456; 102463-102523; 102525-102563; 102579-102597; 102599-102621; 102639-102706; 102745-102787; 102789-102802; 102804-102834; 102849-102879; 102881-102900; 102922-102948; 102963-102993; 102995-103030; 103032-103045; 103063-103158; 103160-103260; 103262-103296; 103304-103330; 103332-103372; 103374-103444; 103458-103485; 103487-103515; 103529-103558; 103560-103581; 103583-103634; 103636-103668; 103681-103697; 103706-103722; 103735-103757; 103759-103772; 103775-103824; 103829-103850; 103885-103947; 103957-103987; 103989-104040; 104052-104068; 104080-104097; 104110-104128; 104153-104171; 104173-104227; 104240-104255; 104271-104299; 104301-104360; 104364-104377; 104384-104407; 104428-104441; 104453-104499; 104501-104518; 104529-104557; 104570-104637; 104639-104662; 104676-104693; 104695-104709; 104712-104728; 104731-104744; 104748-104768; 104782-104798; 104806-104820; 104822-104875; 104884-104907; 104926-104946; 104948-104969; 104999-105029; 105061-105088; 105104-105119; 105121-105182; 105195-105214; 105220-105239; 105242-105282; 105287-105303; 105305-105319; 105321-105375; 105378-105391; 105397-105434; 105468-105517; 105519-105533; 105581-105607; 105628-105642; 105648-105710; 105748-105764; 105774-105804; 105806-105820; 105822-105856; 105867-105888; 105895-105929; 105932-105959; 105965-105993; 106000-106037; 106039-106057; 106059-106097; 106099-106122; 106124-106149; 106152-106165; 106181-106207; 106209-106242; 106252-106318; 106320-106384; 106386-106431; 106433-106446; 106463-106476; 106478-106496; 106513-106539; 106563-106583; 106592-106634; 106649-106678; 106680-106694; 106696-106711; 106729-106743; 106761-106782; 106789-106803; 106805-106819; 106830-106846; 106848-106868; 106871-106892; 106903-106925; 106974-106997; 107011-107026; 107032-107052; 107076-107093; 107105-107187; 107208-107222; 107237-107270; 107285-107304; 107306-107322; 107325-107355; 107357-107377; 107379-107409; 107437-107454; 107458-107521; 107523-107541; 107571-107607; 107609-107630; 107643-107661; 107663-107713; 107726-107770; 107778-107794; 107796-107809; 107811-107836; 107843-107860; 107880-107924; 107951-107976; 107986-108110; 108112-108132; 108134-108152; 108160-108202; 108204-108221; 108223-108236; 108249-108286; 108294-108318; 108339-108356; 108381-108412; 108424-108439; 108441-108460; 108483-108535; 108537-108595; 108597-108650; 108656-108675; 108692-108728; 108742-108766; 108773-108860; 108891-108920; 108930-108999; 109017-109033; 109065-109090; 109092-109120; 109122-109144; 109146-109161; 109166-109226; 109228-109327; 109347-109364; 109374-109395; 109397-109440; 109442-109479; 109481-109499; 109511-109528; 109530-109579; 109583-109606; 109608-109634; 109636-109651; 109685-109706; 109708-109754; 109765-109787; 109865-109879; 109892-109905; 109913-109940; 109942-109968; 109970-109988; 109990-110010; 110012-110056; 110058-110081; 110087-110147; 110149-110165; 110167-110194; 110196-110219; 110221-110237; 110247-110274; 110285-110322; 110324-110373; 110375-110422; 110424-110449; 110467-110483; 110491-110506; 110522-110579; 110599-110642; 110662-110685; 110687-110727; 110729-110764; 110774-110793; 110840-110861; 110868-110895; 110897-110924; 110933-110948; 110952-110977; 111004-111028; 111030-111085; 111092-111110; 111112-111128; 111131-111154; 111156-111171; 111173-111196; 111218-111239; 111241-111272; 111274-111292; 111298-111312; 111321-111343; 111368-111415; 111417-111438; 111457-111487; 111489-111526; 111533-111552; 111554-111628; 111632-111647; 111656-111682; 111684-111712; 111725-111743; 111801-111814; 111835-111849; 111852-111866; 111887-111913; 111922-111937; 111939-111971; 111979-111993; 112001-112019; 112034-112060; 112062-112096; 112112-112176; 112197-112218; 112220-112248; 112250-112268; 112290-112311; 112324-112381; 112383-112408; 112437-112505; 112507-112552; 112554-112599; 112643-112658; 112660-112681; 112695-112711; 112716-112736; 112738-112776; 112778-112814; 112846-112882; 112934-112961; 112990-113006; 113008-113028; 113044-113060; 113119-113142; 113144-113220; 113224-113248; 113255-113276; 113278-113302; 113367-113385; 113399-113427; 113429-113444; 113452-113545; 113547-113580; 113582-113613; 113619-113680; 113682-113704; 113733-113762; 113779-113819; 113846-113859; 113884-113901; 113903-113994; 113996-114082; 114084-114099; 114101-114158; 114190-114231; 114246-114268; 114270-114285; 114298-114316; 114318-114360; 114389-114405; 114407-114469; 114478-114495; 114509-114549; 114556-114570; 114573-114593; 114595-114609; 114612-114631; 114633-114679; 114681-114698; 114700-114725; 114740-114759; 114785-114798; 114800-114817; 114819-114869; 114871-114896; 114899-114912; 114937-114975; 115013-115033; 115035-115063; 115081-115094; 115122-115141; 115143-115180; 115185-115209; 115219-115260; 115276-115326; 115328-115415; 115453-115491; 115493-115540; 115547-115578; 115581-115601; 115603-115651; 115663-115689; 115695-115742; 115749-115786; 115794-115824; 115830-115871; 115875-115894; 115901-115917; 115927-115954; 115956-115989; 115991-116019; 116034-116047; 116067-116103; 116105-116154; 116167-116218; 116220-116290; 116317-116356; 116363-116378; 116380-116454; 116482-116513; 116525-116546; 116557-116571; 116573-116588;

116590-116619; 116621-116690; 116693-116720; 116722-116735; 116737-116860; 116862-116877; 116887-116906; 116922-116943; 116957-117089; 117098-117131; 117133-117149; 117161-117222; 117224-117260; 117305-117318; 117320-117358; 117378-117423; 117425-117473; 117475-117488; 117490-117518; 117520-117551; 117553-117600; 117602-117619; 117639-117668; 117679-117702; 117704-117761; 117768-117803; 117818-117831; 117877-117943; 117945-117985; 118009-118036; 118038-118052; 118064-118080; 118089-118130; 118132-118204; 118207-118240; 118242-118267; 118269-118327; 118329-118349; 118351-118365; 118397-118450; 118482-118534; 118552-118601; 118603-118623; 118626-118657; 118702-118720; 118731-118754; 118796-118815; 118825-118844; 118846-118871; 118877-118899; 118903-118941; 118950-118965; 118970-119016; 119064-119088; 119107-119145; 119179-119239; 119241-119273; 119291-119309; 119311-119358; 119373-119395; 119408-119479; 119481-119598; 119600-119625; 119627-119667; 119680-119714; 119716-119738; 119740-119789; 119791-119805; 119807-119820; 119822-119838; 119841-119855; 119906-119925; 119936-119971; 119987-120003; 120009-120057; 120074-120093; 120095-120133; 120163-120213; 120215-120323; 120327-120344; 120363-120397; 120399-120429; 120435-120481; 120492-120512; 120531-120556; 120562-120628; 120630-120721; 120736-120803; 120805-120897; 120918-120945; 120955-120970; 120972-121108; 121112-121139; 121165-121179; 121195-121262; 121267-121328; 121330-121370; 121385-121426; 121428-121441; 121451-121471; 121473-121490; 121507-121560; 121562-121582; 121619-121638; 121652-121672; 121674-121716; 121727-121753; 121770-121786; 121790-121809; 121854-121880; 121906-121919; 121949-121967; 121969-122013; 122031-122055; 122058-122118; 122122-122147; 122149-122165; 122167-122199; 122208-122245; 122256-122284; 122304-122317; 122348-122434; 122436-122451; 122467-122493; 122509-122590; 122604-122620; 122631-122644; 122662-122694; 122735-122757; 122761-122797; 122799-122877; 122879-122901; 122950-122974; 122976-123047; 123049-123064; 123083-123113; 123115-123184; 123186-123213; 123218-123269; 123271-123284; 123297-123327; 123329-123362; 123365-123435; 123453-123475; 123481-123561; 123585-123621; 123627-123650; 123654-123690; 123692-123709; 123721-123791; 123810-123868; 123890-124126; 124129-124220; 124222-124273; 124304-124318; 124325-124396; 124410-124439; 124441-124474; 124483-124505; 124532-124554; 124577-124627; 124629-124652; 124654-124704; 124706-124738; 124741-124786; 124788-124817; 124820-124881; 124897-124927; 124929-124958; 124960-125024; 125030-125071; 125078-125101; 125103-125165; 125178-125195; 125213-125237; 125239-125271; 125294-125317; 125321-125348; 125361-125411; 125439-125471; 125489-125507; 125512-125631; 125633-125657; 125659-125688; 125696-125723; 125725-125743; 125745-125784; 125786-125803; 125828-125868; 125894-125918; 125933-125949; 125958-125981; 125991-126008; 126021-126041; 126054-126075; 126077-126095; 126097-126139; 126141-126175; 126189-126209; 126212-126228; 126230-126247; 126253-126272; 126307-126340; 126355-126369; 126382-126411; 126413-126451; 126458-126489; 126491-126533; 126535-126550; 126552-126565; 126567-126587; 126595-126654; 126657-126675; 126690-126716; 126720-126804; 126862-126880; 126884-126897; 126901-126926; 126939-126953; 126955-126974; 126983-127000; 127015-127037; 127039-127130; 127142-127173; 127186-127211; 127214-127231; 127238-127295; 127297-127332; 127340-127353; 127371-127402; 127404-127464; 127466-127487; 127489-127573; 127581-127609; 127612-127632; 127650-127682; 127684-127752; 127771-127803; 127859-127880; 127894-127908; 127910-127943; 127955-127979; 127981-128003; 128017-128030; 128078-128104; 128106-128124; 128126-128140; 128146-128227; 128233-128292; 128300-128325; 128327-128422; 128428-128447; 128451-128476; 128499-128520; 128533-128561; 128584-128671; 128692-128706; 128708-128761; 128763-128786; 128799-128815; 128818-128850; 128852-128968; 128976-128991; 128993-129019; 129027-129042; 129044-129074; 129076-129089; 129091-129138; 129140-129242; 129244-129258; 129269-129290; 129292-129332; 129371-129395; 129402-129434; 129469-129530; 129535-129560; 129568-129582; 129594-129629; 129631-129693; 129695-129724; 129727-129741; 129743-129770; 129772-129798; 129800-129832; 129870-129883; 129885-129916; 129918-129937; 129939-130035; 130037-130082; 130087-130100; 130102-130123; 130125-130156; 130158-130179; 130189-130207; 130237-130255; 130257-130279; 130281-130297; 130299-130320; 130322-130340; 130342-130359; 130392-130441; 130456-130481; 130486-130507; 130560-130622; 130624-130655; 130673-130686; 130689-130783; 130791-130805; 130808-130869; 130887-130906; 130915-130938; 130952-130982; 130984-131010; 131018-131035; 131037-131076; 131101-131131; 131133-131159; 131164-131184; 131187-131207; 131209-131244; 131265-131278; 131280-131319; 131342-131358; 131360-131409; 131421-131440; 131481-131495; 131497-131510; 131522-131578; 131590-131613; 131630-131646; 131648-131665; 131706-131728; 131730-131755; 131757-131785; 131820-131835; 131837-131865; 131877-131896; 131910-131934; 131959-131977; 131981-132008; 132045-132060; 132127-132149; 132152-132173; 132181-132199; 132211-132247; 132262-132297; 132323-132346; 132348-132362; 132365-132408; 132413-132445; 132447-132514; 132524-132550; 132553-132573; 132588-132601; 132603-132622; 132637-132661; 132682-132704; 132712-132756; 132769-132783; 132800-132822; 132831-132858; 132889-132938; 132967-132988; 132990-133003; 133025-133073; 133075-133097; 133099-133116; 133127-133148; 133169-133196; 133222-133264; 133285-133308; 133310-133353; 133366-133484; 133486-133525; 133542-133557; 133559-133625; 133641-133660; 133662-133732; 133747-133787; 133789-133810; 133826-133847; 133867-133883; 133885-133955; 133914-133927; 133952-133969; 133971-134022; 134052-134073; 134075-134090; 134092-134129; 134141-134181; 134197-134210; 134215-134249; 134263-134284; 134293-134362; 134372-134420; 134434-134447; 134449-134464; 134476-134497; 134499-134530; 134534-134557; 134559-134617; 134619-134644; 134646-134661; 134663-134677; 134691-134714; 134727-134743; 134761-134827; 134832-134846; 134855-134873; 134895-134954; 134967-134991; 134993-135017; 135033-135077; 135079-135106; 135114-135134; 135145-135191; 135193-135212; 135240-135288; 135296-135343; 135361-135374; 135376-135391; 135418-135478; 135483-135524; 135571-135609; 135624-135700; 135702-135744; 135764-135779; 135794-135820; 135832-135855; 135857-135897; 135902-135927; 135937-135988; 135999-136088; 136090-136109; 136112-136164; 136185-136198; 136202-136242; 136244-136309; 136311-136340; 136342-136356; 136359-136377; 136379-136464; 136467-136555; 136566-136597; 136614-136629; 136632-136679; 136704-136786; 136788-136859; 136867-136920; 136936-136949; 136951-136967; 136978-137020; 137025-137044; 137055-137097; 137134-137158; 137171-137187; 137189-137228; 137251-137271; 137273-137302; 137313-137353; 137355-137373; 137383-137403; 137405-137497; 137499-137537; 137539-137574; 137599-137638; 137642-137669; 137690-137708; 137710-137748;

137750-137838; 137840-137865; 137867-137907; 137909-137937; 137939-137953; 137955-137977; 137993-138020; 138030-138056; 138058-138085; 138087-138103; 138116-138134; 138137-138214; 138216-138248; 138254-138292; 138305-138334; 138342-138374; 138425-138475; 138477-138506; 138508-138542; 138551-138576; 138610-138647; 138664-138685; 138712-138729; 138731-138745; 138763-138781; 138792-138845; 138858-138907; 138909-138943; 138945-138995; 138999-139015; 139024-139040; 139060-139105; 139107-139133; 139145-139178; 139180-139198; 139207-139236; 139238-139253; 139255-139292; 139294-139320; 139329-139488; 139512-139542; 139544-139567; 139582-139596; 139631-139662; 139671-139684; 139686-139699; 139729-139748; 139773-139790; 139799-139820; 139822-139844; 139846-139890; 139896-139920; 139930-139991; 139999-140018; 140023-140112; 140153-140213; 140215-140232; 140234-140268; 140291-140326; 140338-140360; 140367-140415; 140447-140475; 140497-140524; 140529-140624; 140639-140654; 140658-140674; 140676-140716; 140745-140787; 140790-140815; 140817-140841; 140843-140868; 140882-140903; 140905-140929; 140949-140967; 140996-141013; 141026-141055; 141080-141103; 141105-141126; 141138-141192; 141194-141207; 141209-141349; 141383-141396; 141402-141419; 141472-141509; 141511-141533; 141535-141569; 141571-141587; 141596-141639; 141641-141725; 141729-141749; 141756-141831; 141833-141899; 141901-141932; 141948-141991; 141993-142013; 142022-142082; 142084-142104; 142120-142176; 142178-142206; 142208-142221; 142254-142295; 142297-142375; 142398-142413; 142433-142471; 142473-142527; 142529-142601; 142603-142687; 142695-142730; 142732-142751; 142773-142928; 142930-142993; 142996-143020; 143022-143042; 143056-143071; 143073-143092; 143102-143127; 143129-143145; 143158-143187; 143206-143283; 143286-143347; 143349-143378; 143384-143416; 143418-143436; 143447-143478; 143480-143512; 143514-143547; 143560-143599; 143601-143646; 143664-143756; 143758-143771; 143773-143793; 143817-143848; 143850-143863; 143865-143881; 143883-143900; 143902-143919; 143921-143936; 143949-143994; 144018-144086; 144088-144102; 144104-144121; 144148-144164; 144166-144193; 144208-144275; 144277-144293; 144297-144315; 144326-144410; 144421-144505; 144538-144580; 144582-144622; 144624-144637; 144675-144802; 144817-144833; 144835-144849; 144882-144944; 144948-144995; 145005-145044; 145046-145065; 145074-145125; 145136-145158; 145178-145192; 145194-145217; 145219-145254; 145256-145271; 145276-145330; 145332-145345; 145347-145444; 145446-145462; 145493-145507; 145539-145568; 145593-145617; 145619-145647; 145694-145716; 145718-145735; 145737-145809; 145836-145850; 145883-145942; 145944-146005; 146007-146051; 146053-146096; 146150-146174; 146194-146210; 146217-146251; 146253-146294; 146318-146373; 146377-146390; 146392-146417; 146419-146432; 146435-146448; 146451-146471; 146486-146528; 146543-146657; 146659-146766; 146777-146793; 146795-146825; 146837-146887; 146910-146928; 146930-146943; 146945-147005; 147007-147026; 147033-147085; 147087-147163; 147165-147208; 147210-147322; 147361-147387; 147391-147419; 147421-147449; 147454-147472; 147474-147587; 147602-147616; 147618-147642; 147645-147757; 147759-147799; 147801-147866; 147868-147896; 147905-147951; 147975-148005; 148010-148041; 148043-148056; 148099-148130; 148139-148179; 148186-148215; 148217-148242; 148261-148283; 148285-148325; 148327-148369; 148381-148434; 148445-148499; 148527-148542; 148553-148618; 148625-148638; 148640-148678; 148680-148696; 148698-148739; 148752-148768; 148798-148869; 148871-148885; 148913-148930; 148934-149001; 149011-149030; 149040-149099; 149110-149127; 149130-149176; 149193-149225; 149232-149250; 149268-149351; 149353-149461; 149463-149533; 149535-149591; 149602-149651; 149653-149738; 149742-149784; 149786-149799; 149814-149830; 149848-149871; 149917-149932; 149934-149995; 149998-150021; 150025-150041; 150043-150120; 150151-150201; 150206-150229; 150236-150258; 150262-150279; 150283-150318; 150320-150364; 150366-150388; 150402-150442; 150450-150466; 150473-150561; 150563-150597; 150599-150623; 150628-150641; 150656-150679; 150694-150718; 150744-150775; 150796-150822; 150824-150846; 150852-150899; 150908-150928; 150930-150945; 150947-150988; 150990-151022; 151024-151057; 151060-151087; 151101-151127; 151129-151158; 151160-151203; 151216-151233; 151241-151256; 151258-151298; 151310-151330; 151332-151351; 151353-151423; 151439-151464; 151466-151487; 151489-151516; 151534-151554; 151556-151573; 151577-151592; 151612-151645; 151658-151683; 151694-151713; 151740-151774; 151776-151831; 151837-151856; 151861-151874; 151877-151947; 151949-151969; 151984-152046; 152048-152061; 152063-152095; 152097-152112; 152114-152156; 152167-152199; 152213-152270; 152272-152299; 152301-152336; 152361-152374; 152376-152398; 152401-152420; 152426-152479; 152481-152495; 152498-152511; 152513-152526; 152569-152589; 152591-152606; 152613-152631; 152642-152661; 152663-152690; 152705-152720; 152759-152814; 152816-152846; 152848-152895; 152903-152994; 153028-153081; 153083-153115; 153125-153179; 153181-153199; 153202-153253; 153255-153294; 153301-153342; 153358-153418; 153427-153448; 153461-153476; 153478-153535; 153560-153649; 153668-153696; 153732-153747; 153759-153844; 153846-153859; 153861-153888; 153891-153905; 153930-153949; 153951-153986; 153989-154039; 154041-154059; 154063-154112; 154114-154127; 154129-154166; 154168-154224; 154226-154270; 154278-154299; 154301-154315; 154317-154334; 154357-154374; 154378-154398; 154443-154463; 154465-154484; 154520-154574; 154586-154622; 154624-154675; 154706-154723; 154725-154740; 154742-154774; 154776-154808; 154828-154852; 154854-154867; 154883-154899; 154901-154927; 154938-154959; 154981-155001; 155003-155041; 155043-155080; 155082-155100; 155112-155129; 155131-155146; 155148-155182; 155188-155232; 155234-155291; 155293-155314; 155316-155334; 155340-155379; 155383-155401; 155411-155437; 155466-155495; 155497-155511; 155522-155555; 155563-155583; 155585-155641; 155643-155656; 155682-155701; 155703-155718; 155720-155764; 155769-155783; 155785-155820; 155822-155874; 155877-155901; 155913-155927; 155929-155948; 155950-156015; 156083-156110; 156112-156127; 156135-156159; 156161-156201; 156203-156250; 156252-156308; 156314-156327; 156337-156362; 156364-156404; 156414-156428; 156459-156481; 156483-156534; 156549-156601; 156613-156642; 156654-156671; 156673-156687; 156696-156758; 156780-156813; 156832-156848; 156864-156897; 156900-156936; 156954-157019; 157030-157054; 157056-157138; 157141-157216; 157218-157233; 157235-157374; 157377-157394; 157396-157432; 157434-157461; 157573-157591; 157597-157614; 157628-157645; 157687-157704; 157750-157764; 157775-157809; 157822-157858; 157860-157876; 157878-157935; 157940-157963; 157980-158026; 158028-158049; 158052-158072; 158074-158097; 158115-158135; 158143-158189; 158191-158221; 158226-158297; 158324-158378; 158390-158410; 158435-158463; 158465-158498; 158522-158540; 158542-158598; 158606-158621; 158623-158654; 158659-158678; 158680-158709;

158722-158747; 158753-158794; 158824-158886; 158888-158920; 158922-158968; 158975-158998; 159019-159033; 159051-159087; 159089-159112; 159126-159162; 159203-159287; 159289-159303; 159319-159405; 159407-159430; 159433-159507; 159519-159573; 159575-159590; 159592-159606; 159608-159629; 159631-159655; 159667-159715; 159736-159788; 159806-159820; 159822-159868; 159870-159916; 159918-159955; 159982-160009; 160020-160074; 160086-160100; 160143-160224; 160242-160280; 160282-160339; 160341-160355; 160357-160380; 160382-160404; 160406-160472; 160474-160496; 160505-160551; 160553-160595; 160597-160615; 160617-160650; 160652-160674; 160687-160700; 160702-160758; 160760-160773; 160792-160805; 160825-160889; 160904-160940; 160950-161003; 161005-161030; 161032-161050; 161055-161075; 161102-161116; 161118-161132; 161144-161167; 161173-161188; 161190-161331; 161339-161386; 161388-161423; 161425-161461; 161465-161527; 161529-161548; 161560-161657; 161663-161676; 161684-161724; 161729-161743; 161769-161800; 161804-161827; 161843-161874; 161883-161896; 161898-161912; 161933-161967; 161969-162006; 162008-162025; 162051-162111; 162127-162147; 162150-162168; 162183-162197; 162199-162221; 162234-162248; 162273-162291; 162293-162311; 162313-162331; 162341-162367; 162379-162443; 162464-162499; 162507-162550; 162585-162599; 162776-162789; 162967-162980; 163097-163117; 163275-163289; 163362-163406; 163416-163444; 163447-163472; 163481-163495; 163497-163516; 163518-163599; 163601-163632; 163641-163662; 163669-163695; 163708-163767; 163769-163791; 163798-163842; 163846-163866; 163875-163907; 163918-163964; 163998-164023; 164025-164039; 164041-164088; 164090-164111; 164113-164157; 164159-164179; 164192-164234; 164256-164275; 164278-164304; 164337-164408; 164410-164424; 164449-164479; 164831-164844; 164922-164940; 164957-164980; 164985-165004; 165034-165060; 165072-165088; 165090-165103; 165123-165143; 165148-165168; 165185-165204; 165206-165224; 165298-165313; 165319-165332; 165465-165484; 165508-165522; 165543-165556; 165641-165654; 165720-165754; 165821-165836; 165838-165855; 165868-165902; 165919-165934; 165948-165980; 166016-166048; 166144-166190; 166235-166252; 166254-166274; 166312-166326; 166328-166359; 166379-166392; 166484-166498; 166504-166519; 166664-166677; 167174-167188; 167827-167844; 167847-167868; 167872-167889; 167904-167918; 167920-167935; 167952-167992; 167994-168034; 168104-168124; 168140-168180; 168182-168243; 168247-168260; 168272-168314; 168316-168402; 168404-168457; 168459-168606; 168617-168637; 168646-168670; 168697-168744; 168769-168794; 168796-168851; 168874-168908; 168914-168932; 168935-168960; 168970-169018; 169027-169051; 169059-169083; 169085-169110; 169112-169125; 169127-169206; 169208-169231; 169233-169253; 169256-169271; 169273-169335; 169341-169361; 169376-169392; 169401-169424; 169435-169460; 169521-169579; 169581-169612; 169614-169629; 169641-169659; 169661-169782; 169791-169819; 169833-169864; 169898-169916; 169927-169953; 169959-169980; 170012-170026; 170033-170059; 170071-170085; 170100-170119; 170121-170135; 170138-170245; 170247-170309; 170311-170348; 170350-170364; 170385-170412; 170434-170504; 170506-170585; 170597-170610; 170624-170645; 170714-170731; 170736-170763; 170765-170817; 170835-170852; 170859-170872; 170888-170901; 170903-170923; 170926-170940; 170942-171001; 171014-171056; 171058-171135; 171153-171168; 171198-171214; 171221-171244; 171250-171292; 171294-171308; 171310-171330; 171347-171363; 171365-171378; 171388-171411; 171422-171464; 171487-171584; 171586-171635; 171637-171721; 171739-171752; 171766-171820; 171831-171894; 171909-171983; 171985-171998; 172000-172091; 172093-172107; 172145-172161; 172163-172195; 172204-172235; 172237-172267; 172269-172321; 172323-172360; 172365-172379; 172381-172455; 172457-172489; 172492-172519; 172522-172550; 172552-172575; 172578-172617; 172636-172653; 172669-172733; 172739-172755; 172764-172781; 172843-172861; 172875-172909; 172932-172951; 172957-172972; 172977-172994; 173002-173022; 173027-173056; 173058-173082; 173094-173128; 173146-173179; 173181-173222; 173224-173291; 173293-173347; 173349-173365; 173367-173388; 173390-173408; 173429-173459; 173491-173516; 173518-173535; 173537-173568; 173583-173598; 173619-173662; 173671-173686; 173705-173767; 173772-173842; 173844-173887; 173915-173995; 174005-174052; 174068-174134; 174137-174151; 174154-174171; 174209-174272; 174275-174296; 174332-174349; 174358-174371; 174387-174400; 174416-174429; 174445-174458; 174474-174487; 174503-174516; 174532-174545; 174561-174580; 174652-174665; 174701-174760; 174764-174777; 174781-174807; 174816-174829; 174878-174902; 174904-174947; 174949-174962; 174983-175001; 175010-175041; 175053-175073; 175087-175125; 175132-175166; 175176-175191; 175195-175264; 175342-175365; 175368-175416; 175418-175490; 175492-175506; 175526-175550; 175564-175582; 175586-175624; 175659-175706; 175710-175802; 175804-175848; 175856-176047; 176049-176083; 176104-176132; 176136-176165; 176167-176223; 176225-176291; 176293-176310; 176317-176348; 176350-176375; 176377-176477; 176479-176501; 176512-176600; 176602-176714; 176716-176735; 176753-176828; 176830-176855; 176857-176987; 176989-177014; 177016-177053; 177055-177170; 177172-177314; 177316-177331; 177333-177402; 177404-177438; 177440-177459; 177461-177520; 177522-177551; 177572-177592; 177594-177610; 177613-177661; 177668-177692; 177697-177727; 177729-177764; 177766-177784; 177795-177864; 177866-177896; 177898-177957; 177972-177993; 177995-178008; 178010-178042; 178044-178059; 178061-178126; 178130-178148; 178159-178177; 178199-178261; 178268-178287; 178289-178339; 178353-178368; 178372-178406; 178408-178426; 178433-178448; 178455-178499; 178508-178555; 178562-178613; 178618-178697; 178699-178732; 178734-178749; 178752-178765; 178767-178807; 178809-178826; 178858-178887; 178903-178920; 178922-178968; 178976-178989; 179038-179108; 179110-179125; 179148-179164; 179166-179196; 179198-179232; 179234-179255; 179285-179325; 179357-179406; 179410-179426; 179430-179450; 179467-179483; 179485-179556; 179564-179582; 179596-179673; 179687-179719; 179721-179739; 179754-179771; 179787-179805; 179810-179856; 179858-179886; 179888-179905; 179912-179947; 179970-179994; 179996-180070; 180083-180135; 180142-180174; 180185-180205; 180208-180233; 180235-180258; 180260-180274; 180288-180365; 180376-180393; 180395-180410; 180412-180426; 180438-180485; 180493-180536; 180538-180551; 180562-180603; 180605-180658; 180660-180693; 180695-180728; 180730-180770; and 180772-180806. In some embodiments, the contiguous nucleotide sequence of the oligonucleotide of the invention comprises at least 14 contiguous nucleotides which are present in one of the above listed target sequences.

Target Sequence List 2

In some embodiments the target sequence is a region of SEQ ID NO 1 selected from the group consisting of 852-868; 1070-1085; 1512-1526; 2673-2691; 3900-3921; 5165-5182; 5430 -5444; 5610-5624; 5765-5809; 5896-5909;

6859-6872; 6998-7017; 7165-7178; 7297-7317; 8726-8739; 9386-9399; 11712-11725; 11823-11843; 11882-11901; 14186-14199; 15749-15785; 15931-15944; 16137-16150; 17146-17166; 17916-17967; 20196-20213; 20422-20435; 20481-20494; 20883-20900; 21042-21055; 22764-22781; 22978-22992; 25991-26004; 26180-26193; 26621-26634; 26688-26701; 26842-26876; 27744-27759; 30376-30389; 32174-32204; 35003-35016; 35388-35402; 36516-36529; 41753-41766; 42185-42198; 43053-43066; 46413-46426; 48933-48946; 50295-50308; 51695-51709; 54188-54212; 54463-54482; 55841-55854; 55961-55975; 57416-57429; 58396-58410; 58671-58684; 59251-59264; 59294-59308; 60959-60973; 61339-61354; 61631-61644; 63172-63189; 64225-64251; 64254-64280; 64300-64332; 64340-64367; 64399-64421; 64423-64442; 64462-64476; 64478-64502; 64625-64671; 64720-64733; 65457-65479; 65963-65978; 66330-66343; 66660-66673; 66754-66770; 67055-67079; 67231-67245; 67778-67791; 68135-68148; 68548-68566; 68629-68642; 68665-68678; 68821-68834; 68925-68938; 68943-68974; 68991-69043; 69140-69153; 69223-69236; 69263-69276; 69393-69417; 69419-69438; 69440-69461; 69500-69514; 69598-69612; 70079-70126; 70128-70145; 70147-70162; 70164-70186; 70188-70217; 70344-70359; 70377-70390; 70716-70732; 70742-70762; 71359-71373; 71390-71406; 71481-71494; 71548-71566; 71599-71614; 71655-71729; 71731-71788; 71790-71824; 71834-71847; 71856-71903; 71929-71945; 71947-71991; 71995-72010; 72047-72065; 72101-72130; 72154-72172; 72273-72288; 72518-72532; 72622-72639; 72652-72666; 72753-72776; 72981-72994; 73174-73188; 73239-73253; 73659-73672; 73760-73779; 73820-73833; 74025-74038; 74127-74154; 74849-74865; 75190-75204; 75601-75614; 75831-75844; 75987-76000; 76430-76443; 76547-76564; 77078-77092; 77442-77456; 77740-77753; 78041-78054; 78625-78644; 78682-78696; 78772-78808; 78955-78970; 79466-79479; 79545-79558; 80688-80704; 81031-81048; 81360-81417; 81429-81443; 81527-81542; 81555-81580; 81707-81720; 81924-81939; 82166-82179; 82376-82389; 82670-82695; 82709-82729; 82745-82761; 82763-82777; 83468-83484; 83512-83529; 83671-83685; 83848-83861; 84565-84580; 85147-85163; 85464-85477; 85607-85620; 86283-86298; 86341-86354; 86371-86387; 86776-86789; 87084-87097; 87209-87223; 87237-87265; 87341-87354; 87383-87399; 87404-87442; 87464-87489; 87503-87534; 87579-87593; 87677-87690; 87826-87843; 87877-87908; 88033-88048; 88393-88409; 88574-88588; 89078-89091; 89442-89469; 89475-89521; 89523-89536; 89595-89617; 89780-89793; 89896-89909; 89927-89945; 90609-90622; 90887-90900; 90964-90977; 91076-91091; 91173-91191; 91193-91218; 91220-91247; 91310-91324; 91326-91347; 91360-91383; 91409-91425; 91484-91556; 91565-91579; 91639-91665; 91790-91803; 91955-91968; 92064-92077; 92289-92302; 92387-92401; 92434-92457; 92580-92593; 92753-92771; 93022-93035; 93402-93423; 93634-93650; 93845-93862; 94044-94059; 94090-94103; 94296-94318; 94798-94811; 95141-95155; 95400-95413; 95418-95431; 95436-95460; 95463-95506; 95510-95548; 95550-95596; 95613-95626; 95632-95645; 95768-95781; 95843-95863; 95888-95902; 96058-96071; 96469-96487; 96591-96606; 96664-96681; 96785-96799; 96871-96886; 97126-97145; 97149-97164; 97221-97258; 97298-97313; 97325-97344; 97358-97372; 97686-97699; 97701-97720; 97731-97756; 97776-97795; 97848-97867; 97913-97929; 98097-98110; 98352-98365; 98598-98616; 98646-98670; 98672-98688; 98725-98751; 98759-98772; 98783-98811; 98813-98847; 98879-98910; 98912-98949; 98972-99003; 99005-99037; 99221-99234; 99804-99818; 99870-99884; 100038-100052; 100346-100359; 100404-100421; 100567-100581; 101224-101238; 101663-101676; 101783-101798; 102325-102342; 102490-102504; 102643-102657; 102815-102828; 103063-103076; 103078-103100; 103110-103123; 103160-103185; 103244-103260; 103265-103296; 103376-103395; 103487-103515; 103560-103581; 103583-103601; 103655-103668; 103810-103823; 104053-104068; 104110-104127; 104595-104608; 104676-104690; 104845-104868; 104886-104904; 105220-105239; 105412-105431; 105786-105800; 106108-106121; 106851-106864; 107384-107403; 107506-107521; 107670-107683; 107778-107794; 108395-108408; 109411-109427; 110200-110215; 110617-110630; 111065-111079; 111133-111149; 111376-111389; 112034-112047; 113468-113481; 113560-113574; 115512-115528; 115628-115651; 116119-116132; 116171-116186; 116321-116334; 116602-116619; 116668-116682; 116705-116720; 116749-116778; 116793-116819; 116839-116860; 116922-116939; 116966-116982; 117046-117059; 117183-117201; 117779-117792; 117922-117939; 117948-117968; 117970-117983; 118089-118107; 118218-118233; 118825-118838; 119198-119218; 119245-119263; 119374-119388; 119654-119667; 120076-120089; 120540-120556; 120859-120882; 121515-121528; 121538-121551; 122088-122107; 122407-122422; 122516-122530; 122827-122841; 122843-122860; 122982-122995; 123083-123099; 123170-123184; 123186-123203; 123218-123247; 123300-123326; 123369-123393; 123521-123534; 123628-123645; 123896-123909; 123918-123936; 124093-124107; 124154-124169; 124171-124190; 124602-124615; 124689-124702; 124981-124997; 125140-125158; 125593-125606; 125752-125765; 126258-126272; 126383-126396; 127155-127168; 127319-127332; 127589-127605; 127657-127676; 127862-127875; 128818-128847; 128856-128871; 128976-128991; 129107-129121; 129671-129685; 130005-130025; 130049-130063; 130689-130706; 130732-130745; 131020-131034; 131103-131118; 131846-131861; 132413-132426; 132719-132733; 132841-132856; 133295-133308; 133324-133337; 133395-133412; 133414-133432; 133444-133469; 133471-133484; 133565-133579; 133667-133684; 134235-134248; 134730-134743; 134833-134846; 135091-135106; 135161-135175; 135451-135464; 135497-135517; 135588-135603; 135640-135656; 135728-135741; 136146-136159; 136413-136429; 136758-136782; 137502-137520; 137557-137574; 137690-137708; 137730-137748; 137774-137793; 137813-137838; 137844-137862; 137873-137896; 138185-138198; 138671-138684; 138800-138813; 139896-139910; 139950-139963; 140058-140081; 140195-140211; 140291-140304; 140312-140326; 140453-140466; 140756-140769; 141209-141222; 141238-141255; 141297-141312; 141622-141639; 142152-142174; 142262-142281; 142358-142371; 142537-142559; 142561-142583; 142615-142637; 142639-142681; 142717-142730; 143077-143090; 143169-143182; 143236-143266; 143268-143283; 143354-143368; 143616-143646; 144061-144074; 144430-144458; 144589-144603; 144783-144796; 144982-144995; 145194-145208; 145718-145731; 145737-145754; 145770-145793; 145907-145924; 146150-146166; 146220-146235; 146238-146251; 146600-146629; 146695-146736; 146846-146864; 146987-147002; 147054-147079; 147087-147103; 147111-147128; 147144-147163; 147171-147185; 147222-147272; 147282-147295; 147297-147318; 147727-147755; 148194-148209; 148302-148316; 148752-148767; 149049-149067; 149195-149210; 149237-149250; 149295-149313; 149325-149338; 149353-149419; 149421-149457; 149473-149486; 149682-149700; 149786-149799; 149849-149868; 150328-150341; 150452-150465; 150701-150714; 150865-150880; 151556-151571; 151577-151590; 151700-151713; 151837-151855; 151906-151921; 152173-152186; 152613-152631; 152770-152785;

152957-152970; 153028-153074; 153221-153235; 153359-153376; 153806-153819; 153972-153986; 153993-154006; 154283-154296; 154586-154602; 154608-154621; 154627-154641; 154780-154796; 154914-154927; 155159-155172; 155749-155762; 155884-155900; 156707-156721; 156960-156976; 156993-157018; 157200-157216; 157289-157306; 157573-157591; 158033-158046; 158733-158747; 158826-158842; 159019-159032; 159090-159107; 159149-159162; 159203-159225; 159339-159361; 159882-159896; 160203-160224; 160434-160447; 160513-160526; 161476-161502; 162507-162542; 163573-163590; 164410-164423; 164923-164938; 165090-165103; 165465-165484; 165967-165980; 166254-166274; 166504-166519; 167830-167844; 168140-168153; 168545-168576; 169037-169050; 169288-169301; 169542-169555; 169725-169739; 169760-169774; 170045-170058; 170257-170273; 170552-170566; 170979-170995; 171222-171235; 171388-171401; 171425-171449; 171489-171511; 171518-171551; 171565-171581; 171586-171605; 171637-171651; 171778-171808; 171834-171850; 171852-171880; 171924-171937; 171939-171964; 171966-171983; 171985-171998; 172011-172034; 172036-172053; 172070-172083; 172182-172195; 172702-172717; 173158-173171; 173187-173200; 173429-173442; 173497-173510; 173754-173767; 173788-173801; 173820-173835; 173864-173881; 173940-173953; 174154-174167; 174275-174288; 174701-174740; 174782-174795; 174816-174829; 175351-175364; 175398-175412; 175434-175447; 175493-175506; 175985-176026; 176167-176219; 176245-176285; 176317-176348; 176382-176402; 176404-176423; 176449-176469; 176515-176555; 176662-176678; 176683-176708; 176716-176735; 176767-176801; 176803-176816; 176830-176846; 176869-176915; 176927-176948; 176950-176981; 176989-177008; 177022-177047; 177064-177078; 177103-177140; 177181-177206; 177235-177248; 177253-177269; 177282-177308; 177349-177366; 177419-177438; 177476-177498; 177594-177610; 177631-177658; 177795-177813; 177866-177886; 177928-177941; 177943-177957; 178012-178030; 178218-178231; 178268-178282; 178781-178795; 178809-178826; 179174-179187; 179213-179227; 179287-179306; 179358-179382; 179500-179519; 179696-179709; 180302-180316; 180340-180357; 180378-180393; 180395-180410; 180438-180454; 180462-180480; 180582-180596; 180634-180658; 180679-180693; 180699-180726; and 180753-180771. In some embodiments, the contiguous nucleotide sequence of the oligonucleotide of the invention comprises at least 14 contiguous nucleotides which are present in one of the above listed target sequences.

Target Sequence List 3

In some embodiments the target sequence is a region of SEQ ID NO 1 selected from the group consisting of 852-865; 2091-2104; 2620-2633; 2675-2692; 3441-3454; 3882 3921; 3970-3983; 4532-4553; 4814-4827; 5068-5082; 5167-5182; 5184-5198; 5430-5444; 5466-5502; 5511-5529; 5544-5585; 5610-5633; 5644-5662; 5695-5717; 6067-6085; 6087-6100; 6117-6130; 6859-6873; 6998-7019; 7033-7053; 7089-7121; 7131-7152; 7155-7184; 7206-7221; 7254-7271; 7273-7295; 7297-7315; 7381-7414; 7456-7475; 7478-7499; 7509-7522; 7618-7632; 8388-8401; 8508-8529; 8538-8562; 8596-8610; 8612-8638; 8655-8677; 8693-8715; 8944-8957; 9534-9547; 9914-9928; 10068-10081; 10252-10265; 10363-10376; 10402-10415; 10626-10640; 11437-11450; 11879-11901; 11981-11994; 12145-12158; 12980-12993; 13998-14011; 15098-15111; 15628-15642; 15749-15792; 15801-15821; 15847-15863; 15869-15911; 15931-15959; 15972-15985; 16019-16037; 16039-16052; 16740-16753; 17660-17676; 17696-17731; 17761-17774; 17800-17827; 17851-17871; 17878-17896; 17906-17967; 18825-18843; 19063-19080; 19821-19834; 19932-19983; 20024-20039; 20045-20062; 20090-20125; 20153-20183; 20196-20212; 20288-20301; 20416-20435; 20481-20494; 20715-20728; 20739-20756; 20808-20826; 20830-20843; 20847-20874; 20892-20905; 20932-20959; 21684-21697; 22764-22780; 22819-22836; 22856-22869; 22880-22907; 22979-22992; 23370-23383; 23917-23930; 25007-25020; 26048-26068; 26104-26160; 26170-26200; 26224-26238; 26270-26301; 26618-26635; 26843-26878; 26915-26932; 26945-26958; 26961-26978; 27013-27027; 27068-27085; 27218-27231; 27927-27941; 28777-28795; 29103-29116; 29389-29403; 29985-29998; 30360-30374; 30376-30390; 30768-30782; 32173-32206; 32237-32251; 32260-32274; 32334-32360; 32569-32583; 32597-32611; 32749-32763; 33254-33268; 33299-33314; 33492-33506; 34233-34247; 34360-34375; 34562-34576; 34689-34703; 35106-35135; 35142-35169; 35259-35275; 35280-35308; 35333-35346; 35382-35470; 35477-35490; 35494-35534; 35883-35896; 36784-36797; 37504-37518; 39690-39704; 40005-40018; 41020-41037; 41749-41762; 43000-43013; 43043-43061; 44274-44287; 44297-44312; 44707-44720; 45664-45677; 46383-46397; 46412-46439; 46690-46703; 47443-47456; 47692-47707; 48415-48429; 48575-48597; 48608-48628; 48637-48650; 48657-48672; 48712-48728; 48798-48811; 48826-48840; 51683-51720; 51734-51752; 51759-51776; 51795-51825; 51897-51910; 52031-52044; 53317-53332; 53975-53988; 54189-54210; 54303-54316; 54334-54347; 54425-54438; 54463-54492; 54557-54573; 54618-54639; 55625-55639; 55821-55834; 56023-56036; 56641-56655; 56689-56703; 57413-57427; 59206-59219; 59282-59313; 59328-59353; 59360-59382; 59384-59413; 59444-59461; 59505-59540; 59566-59580; 60084-60097; 60292-60305; 61606-61619; 62447-62460; 62763-62776; 63174-63187; 63859-63874; 64171-64184; 64462-64475; 64623-64671; 64800-64817; 64858-64873; 64875-64902; 64928-64949; 64959-64983; 64985-65003; 65044-65065; 65078-65113; 65115-65169; 65171-65186; 65188-65238; 65240-65294; 65323-65365; 65368-65438; 65448-65512; 65517-65611; 65619-65640; 65692-65712; 65714-65765; 65767-65840; 65842-65894; 65920-65973; 65985-66014; 66025-66042; 66074-66091; 66101-66120; 66156-66182; 66216-66232; 66266-66282; 66284-66301; 66324-66346; 66366-66382; 66406-66423; 66440-66469; 66480-66495; 67055-67089; 67091-67113; 67128-67170; 67186-67202; 67231-67256; 67258-67294; 67310-67333; 67336-67351; 67597-67616; 67754-67768; 67862-67875; 68793-68806; 69042-69055; 69686-69699; 70176-70193; 70622-70635; 70756-70769; 71228-71241; 71564-71577; 71926-71941; 73372-73386; 74239-74252; 74809-74822; 74848-74880; 74890-74941; 74963-74993; 75005-75027; 75037-75066; 75075-75092; 76262-76276; 76615-76628; 76940-76953; 77233-77246; 78634-78647; 78772-78825; 78867-78888; 78890-78909; 78914-78940; 78955-78986; 78989-79024; 79026-79039; 79041-79056; 79058-79075; 80011-80024; 80858-80871; 81031-81044; 81088-81101; 81166-81179; 82854-82868; 83250-83263; 83621-83636; 83781-83796; 83848-83861; 83867-83885; 83887-83921; 83927-83950; 83986-84001; 84015-84040; 84060-84073; 84075-84097; 84168-84183; 84302-84319; 84335-84348; 84368-84390; 84419-84453; 84480-84501; 84503-84518; 84534-84547; 84549-84567; 84569-84583; 84653-84667; 84693-84708; 84740-84771; 84776-84795; 84824-84839; 84855-84873; 84878-84894; 84896-84911; 85017-85038; 85059-85076; 85079-85102; 85113-85126; 85147-85194; 85252-85267; 85281-85294; 85359-85378; 85470-85486; 85668-85682; 85713-85734; 85771-85793; 85825-85838; 85842-85873; 85876-85902; 86132-86151; 86303-86316; 86438-86468; 86489-86522; 86524-86548;

86554-86570; 86575-86588; 86603-86618; 86636-86651; 86676-86689; 86717-86741; 86776-86803; 86965-86978; 87641-87654; 87707-87720; 87826-87839; 87845-87858; 87879-87910; 88019-88059; 88602-88616; 89155-89168; 89484-89497; 89866-89879; 90038-90051; 92157-92170; 92940-92953; 93333-93348; 93404-93418; 93488-93511; 94835-94851; 96790-96805; 98015-98029; 98877-98892; 98918-98931; 100403-100426; 100436-100456; 100462-100475; 100492-100534; 100562-100588; 100607-100627; 100653-100667; 100671-100685; 102125-102138; 102391-102404; 102992-103005; 104110-104128; 104153-104171; 104224-104243; 104336-104349; 105025-105038; 105219-105240; 105260-105273; 105287-105300; 105321-105336; 105353-105367; 105417-105431; 105462-105478; 105777-105793; 106242-106256; 107381-107403; 107554-107567; 107801-107814; 108248-108261; 108503-108517; 108882-108899; 108928-108944; 109070-109086; 109294-109307; 109411-109427; 109935-109950; 110122-110145; 110196-110210; 110366-110379; 110512-110525; 110563-110576; 110690-110705; 111068-111083; 111506-111520; 111626-111639; 111974-111987; 112693-112706; 112899-112912; 113806-113819; 114115-114128; 115700-115713; 116267-116280; 116833-116846; 117447-117461; 117562-117575; 117932-117945; 118556-118569; 118652-118665; 119346-119359; 120785-120798; 120858-120890; 120974-120988; 122466-122479; 123217-123231; 123785-123798; 124982-124997; 125621-125634; 126633-126646; 127044-127057; 127066-127090; 127108-127130; 127196-127211; 127244-127265; 127269-127296; 127322-127335; 128260-128275; 128300-128318; 128339-128360; 128363-128381; 128394-128422; 128425-128444; 128822-128848; 130000-130013; 131029-131042; 131184-131197; 131926-131939; 133001-133014; 133472-133493; 134969-134982; 135682-135697; 136759-136791; 136794-136829; 136858-136871; 137867-137883; 138425-138438; 138521-138534; 138969-138983; 139291-139320; 139337-139422; 139436-139471; 139515-139544; 139550-139581; 140314-140327; 140582-140596; 141239-141252; 142647-142660; 142816-142829; 143236-143274; 144208-144246; 144250-144275; 144308-144322; 144326-144340; 144348-144387; 144393-144415; 144431-144454; 145603-145618; 146615-146628; 147007-147020; 147063-147076; 147108-147121; 147267-147280; 147455-147468; 147480-147531; 147545-147597; 147601-147615; 147618-147641; 147644-147668; 147679-147706; 147708-147755; 147972-147998; 148303-148316; 149483-149496; 150121-150136; 151760-151773; 152089-152102; 152533-152546; 152616-152630; 152825-152838; 152956-152972; 153029-153059; 153061-153076; 153093-153114; 153125-153177; 153181-153198; 153211-153253; 153255-153289; 153301-153341; 153359-153376; 153381-153395; 153398-153417; 153421-153442; 153461-153476; 153483-153504; 153507-153532; 153577-153596; 153603-153627; 153629-153643; 153805-153819; 154379-154401; 154483-154501; 154535-154552; 154586-154602; 154823-154840; 154918-154931; 156311-156324; 156466-156484; 156521-156535; 156576-156590; 156614-156629; 156654-156678; 156707-156721; 156723-156753; 156777-156798; 156833-156849; 156871-156885; 156984-157019; 157078-157111; 157154-157170; 157192-157217; 157236-157289; 157293-157307; 157338-157375; 157412-157426; 157430-157443; 157561-157588; 157593-157619; 157628-157655; 157673-157739; 158005-158018; 158258-158278; 158422-158435; 158522-158545; 158694-158708; 159274-159292; 159346-159360; 159590-159603; 159859-159872; 159968-159981; 160208-160223; 160251-160267; 161102-161115; 161187-161332; 161337-161386; 161388-161502; 161618-161631; 162043-162056; 162561-162575; 163052-163065; 163084-163097; 164109-164123; 164923-164938; 164958-164980; 165017-165032; 165034-165047; 165049-165063; 165065-165079; 165134-165149; 165185-165224; 165467-165483; 165516-165529; 165587-165604; 165608-165621; 165644-165665; 165697-165718; 165720-165748; 165750-165774; 165777-165836; 165838-165852; 165862-165946; 165948-165980; 166005-166050; 166060-166102; 166122-166160; 166163-166218; 166220-166239; 166254-166307; 166312-166359; 166366-166391; 166508-166522; 167252-167265; 167319-167332; 168224-168237; 168272-168313; 168334-168348; 168356-168394; 168416-168447; 168477-168491; 168503-168519; 168541-168579; 169037-169052; 169342-169366; 169376-169400; 169411-169424; 169435-169460; 169496-169517; 169519-169540; 169555-169573; 169600-169629; 169631-169653; 169655-169695; 169697-169722; 169729-169782; 169791-169807; 169831-169847; 169850-169883; 169898-169925; 169937-169954; 169959-169980; 169982-170005; 170007-170021; 170036-170058; 170069-170097; 170105-170136; 170138-170232; 170247-170309; 170311-170347; 170350-170385; 170395-170418; 170434-170466; 170469-170483; 170485-170503; 170509-170532; 170534-170562; 170568-170585; 170624-170641; 170654-170675; 170685-170709; 170712-170731; 170745-170758; 170778-170791; 170859-170892; 170948-170969; 171019-171059; 171070-171086; 171090-171123; 171465-171478; 171526-171539; 171571-171584; 171645-171660; 172651-172670; 172985-172999; 173795-173808; 174279-174304; 174323-174355; 175105-175123; 175143-175166; 175221-175241; 175350-175364; 175493-175506; 175707-175793; 175804-175849; 175854-175941; 175944-176027; 176245-176258; 176323-176337; 176620-176636; 176719-176732; 179965-179994; 180044-180060; 180072-180104; 180136-180149; 180208-180225; 180266-180280; and 180634-180647. Oligonucleotides, such as antisense oligonucleotides which target these regions (Target Sequence List 3) of SEQ ID NO 1 may further target the human SCN10A nucleic acid target. In some embodiments, the contiguous nucleotide sequence of the oligonucleotide of the invention comprises at least 14 contiguous nucleotides which are present in one of the above listed target sequences.

Target Sequence List 4

In some advantageous embodiments the target sequence is a region of SEQ ID NO 1 selected from the group consisting of 99525-99542; 70094-70110; 133396-133411; 20666-20682; 103244-103261; 20666-20683; 103244-103262; 147238-147253; 171787-171803; 171787-171803; 147238-147253; 171788-171803; 103244-103260; 103244-103262; 130009-130025; 103244-103261; 98600-98616; 103244-103262; 171788-171803; 103244-103261; 70094-70110; 70094-70110; 70094-70110; 70094-70110; 70094-70110; 70094-70110; 70094-70110; 20666-20683; 97712-97728; 75261-75277; 75260-75276; 97713-97730; 75261-75277; 97712-97729; 20666-20683; 97712-97729; 20666-20683; 4426-4443; 75260-75276; 97715-97731; 20666-20683; 97712-97728; 4427-4443; 20666-20683; 97712-97729; 89475-89493; 99308-99324; 13076-13094; 87509-87527; 103272-103290; 82676-82692; 99526-99543; 82675-82691; 87510-87528; 97704-97720; 82675-82691; 89477-89495; and 13076-13094. In some embodiments, the contiguous nucleotide sequence of the oligonucleotide of the invention comprises at least 14 contiguous nucleotides which are present in one of the above listed target sequences.

Target Sequence List 5

In some advantageous embodiments the target sequence is an exon region of SEQ ID NO 1 selected from the group consisting of E1; E2; E3; E4; E5; E6; E7; E8; E9; E10; E11;

E12; E13; E14; E15; E16; E17; E18; E19; E20; E21; E22; E23; E24; E25; E26; and E27.

Target Sequence List 6

In some advantageous embodiments the target sequence is an intron region of SEQ ID NO 1 selected from the group consisting of I1; I2; I3; I4; I5; I6; I7; I8; I9; I10; I11; I12; I13; I14; I15; I16; I17; I18; I19; I20; I21; I22; I23; I24; I25; and I26.

In some embodiments, the contiguous nucleotide sequence of the oligonucleotide of the invention comprises at least 12 contiguous nucleotides which are present in the target sequence, such as a target sequence selected from those presented in Target Sequence list 1, 2, 3, 4, 5 & 6.

In some embodiments, the contiguous nucleotide sequence of the oligonucleotide of the invention comprises at least 14 contiguous nucleotides which are present in the target sequence, such as a target sequence selected from those presented in Target Sequence list 1, 2, 3, 4, 5 & 6.

In some embodiments, the contiguous nucleotide sequence of the oligonucleotide of the invention comprises at least 15 contiguous nucleotides which are present in the target sequence, such as a target sequence selected from those presented in Target sequence list 1, 2, 3, 4, 5 & 6.

Advantageous Target Regions

In some embodiments, the invention provides an oligonucleotide according to the invention which comprises a contiguous nucleotide sequence of at least 12 nucleotides in length which is 100% complementary to a sequence selected from the group consisting of SEQ ID NO 17-49.

In some embodiments, the invention provides an oligonucleotide according to the invention which comprises a contiguous nucleotide sequence of at least 14 nucleotides in length which is 100% complementary to a sequence selected from the group consisting of SEQ ID NO 17-49.

| SEQID | Target_seq | Region of SEQ ID No 1 start | end | length |
|---|---|---|---|---|
| 17 | GAAAATACGATATCCA | 16910 | 16925 | 16 |
| 18 | GAAGAGGAATTAAAATATA | 64215 | 64233 | 19 |
| 19 | GATTAGTGAAATTTAGTGAA | 64574 | 64593 | 20 |
| 20 | TATTTGTAAAAGAGCTGT | 70638 | 70655 | 18 |
| 21 | TGGATTTTTTTATGAATGGA | 71294 | 71313 | 20 |
| 22 | AAGAGGTGTTTAAATCA | 75259 | 75275 | 17 |
| 23 | TGAATGAGTAGTTATATAT | 76831 | 76849 | 19 |
| 24 | TGGTTGATAGATCATGA | 77336 | 77352 | 17 |
| 25 | TATTATGGAGAAATATACTGT | 77664 | 77684 | 21 |
| 26 | TGGTGAATGAAAAGTAAGA | 80259 | 80277 | 19 |
| 27 | GAGAATATATGAGAAAATAGTA | 81183 | 81204 | 22 |
| 28 | GAATTAGAATTTCAACAGA | 87509 | 87527 | 19 |
| 29 | TGTGTAAAGAAAACGAT | 89233 | 89249 | 17 |
| 30 | AAGAGATATAGGATCTG | 91258 | 91274 | 17 |
| 31 | TGTAAAAAGGTACTTGT | 91752 | 91768 | 17 |
| 32 | TTGGGAGTTGATAATGATT | 95878 | 95896 | 19 |
| 33 | AATGGTATTAAAACTGAT | 97715 | 97732 | 18 |
| 34 | TGTTTACATGATGGTCAT | 98983 | 99000 | 18 |
| 35 | TATTTGTGATGATGTGATCTATT | 99064 | 99087 | 24 |
| 36 | ATGAAGTTAATAATGGAC | 99356 | 99373 | 18 |
| 37 | TAAGTGGTTAAAATAATCA | 99525 | 99543 | 19 |
| 38 | TGGTGTGAGAGTTATGTTT | 101191 | 101209 | 19 |
| 39 | TAGAATTAAAATTTAAGGAAA | 101406 | 101426 | 21 |
| 40 | ATTGAAATGGTTAAGGA | 101534 | 101550 | 17 |
| 41 | TGAGAAAAAAAATAATTAA | 102373 | 102392 | 20 |
| 42 | TAAGAATTGAGAAATAATGAAGGTTCAAGATCTAGAGGAAATTTGTTTGATAAGATATTAAGCTGT | 107237 | 107302 | 66 |
| 43 | TGAAATAGTGATGGTTGT | 107586 | 107603 | 18 |

-continued

| SEQID | Target_seq | Region of SEQ ID No 1 | | |
|---|---|---|---|---|
| | | start | end | length |
| 44 | TATGTGTAAAATAGATTGTAA | 107812 | 107832 | 21 |
| 45 | TTGGTAATAATGTGTGATTT | 113551 | 113570 | 20 |
| 46 | TGAATTGATTATAAAAGTAA | 117040 | 117059 | 20 |
| 47 | TGATAAATTTGTAAGTGAA | 120589 | 120607 | 19 |
| 48 | GATGATTGAGTTTAAAGAA | 121347 | 121365 | 19 |
| 49 | ATGATTGGAAAATAAAGA | 125835 | 125852 | 18 |

Target Cell

The term a "target cell" as used herein refers to a cell which is expressing the target nucleic acid. In some embodiments the target cell may be in vivo or in vitro. In some embodiments the target cell is a mammalian cell such as a pig cell or a rodent cell, such as a mouse cell or a rat cell, or a primate cell such as a monkey cell or a human cell.

In some embodiments the target cell may be a dorsal root ganglion cell, such as a C fiber cell, or a somatosensory cell.

For in vitro assessment, the target cell may be an established cell line, such as SK-N-AS neuroblastoma cells, which is available from ATCC (CRL-2137).which as illustrated in the examples may be used for in vitro screening. Other exemplary target cells include SH-SY5Y cells (also available from ATCC, CRL-2266), or neuronal cells derived from human or pig IPSCs, or primary neurons such as pig primary neurons or human primary neurons (such as primary neurons isolated from dorsal root ganglions)—these may also be used for in vitro screening.

Advantageously the target cell expresses the SCN9A target.

Inhibition of the Target

The oligonucleotide of the invention is capable of down-regulating (inhibiting) the expression of human SCN9A in a cell which is expressing human SCN9A (such as the human $Na_v1.7$ encoded by SEQ ID NO 1). The inhibition of SCN9A results in the inhibition of $Na_v1.7$ protein in the cell, which may be determined by the protein level of $Na_v1.7$ or by a $Na_v1.7$ activity assay.

Therefore, advantageously the oligonucleotide of the invention is capable of down-regulating (inhibiting) the expression of human $Na_v1.7$ in a cell which is expressing human $Na_v1.7$ (such as the human $Na_v1.7$ encoded by SEQ ID NO 1).

In some embodiments the antisense oligonucleotide of the invention is capable of modulating the expression of the target by inhibiting or down-regulating it. Preferably, such modulation produces an inhibition of expression of at least 20% compared to the normal expression level of the target, more preferably at least 30%, at least 40%, at least 50%, at least 60%, at least 70%, at least 80%, or at least 90% inhibition compared to the normal expression level of the target. In some embodiments oligonucleotides of the invention may be capable of inhibiting expression levels of SCN9A mRNA by at least 50% or 60% in vitro following gymnotic application of 5 μM oligonucleotide in SK-N-AS neuroblastoma cells, which are available from ATCC (CRL-2137)—see the examples for suitable methodology using gymnotic delivery. In some embodiments compounds of the invention may be capable of inhibiting expression levels of SCN9A protein by at least 70% in vitro using 5 μM oligonucleotide to SK-N-AS neuroblastoma cells as described above.

Suitably, the examples provide assays which may be used to measure SCN9A inhibition.

Naturally Occurring Variant

The term "naturally occurring variant" refers to variants of SCN9A or SCN10A gene or transcripts which originate from the same genetic loci as the target nucleic acid, but may differ for example, by virtue of degeneracy of the genetic code causing a multiplicity of codons encoding the same amino acid, or due to alternative splicing of pre-mRNA, or the presence of polymorphisms, such as single nucleotide polymorphisms (SNPs), and allelic variants. Based on the presence of the sufficient complementary sequence to the oligonucleotide, the oligonucleotide of the invention may therefore target the target nucleic acid and naturally occurring variants thereof.

In some embodiments, the naturally occurring variants have at least 95% such as at least 98% or at least 99% homology to a mammalian SCN9A or SCN10A target nucleic acid, such as a target nucleic acid selected form the group consisting of SEQ ID NO: 1, 2, and 3. In some embodiments the naturally occurring variants have at least 99% homology to the human SCN9A target nucleic acid, such as that presented as SEQ ID NO: 1.

Modulation of Expression

The term "inhibition of expression" as used herein is to be understood as an overall term for an oligonucleotide's ability to decrease the level of target nucleic acid or target protein when compared to the amount of target nucleic acid or target protein before administration of the oligonucleotide. It will be understood that depending upon the mechanism of action, and antisense oligonucleotide may decrease the level of the target nucleic acid (e.g. via RNaseH cleavage), or may decrease the functionality (or alter the functionality) of the target nucleic acid, e.g. via modulation of splice switching or the pre-RNA.

Modulation, such as inhibition of expression may be determined by reference to a control experiment. It is generally understood that the control is an individual or target cell treated with a saline composition or an individual or target cell treated with a non-targeting oligonucleotide (mock).

One type of modulation is the ability of an oligonucleotide to inhibit, down-regulate, reduce, suppress, remove, stop, block, prevent, lessen, lower, avoid or terminate expression of the target or target nucleic acid, e.g. by degradation of mRNA or blockage of transcription.

High Affinity Modified Nucleosides

A high affinity modified nucleoside is a modified nucleotide which, when incorporated into the oligonucleotide enhances the affinity of the oligonucleotide for its complementary target, for example as measured by the melting temperature ($T_m$). A high affinity modified nucleoside of the present invention preferably result in an increase in melting temperature between +0.5 to +12° C., more preferably between +1.5 to +10° C. and most preferably between +3 to +8° C. per modified nucleoside. Numerous high affinity modified nucleosides are known in the art and include for example, many 2' substituted nucleosides as well as locked nucleic acids (LNA) (see e.g. Freier & Altmann; Nucl. Acid Res., 1997, 25, 4429-4443 and Uhlmann; Curr. Opinion in Drug Development, 2000, 3(2), 293-213).

Sugar Modifications

The oligomer of the invention may comprise one or more nucleosides which have a modified sugar moiety, i.e. a modification of the sugar moiety when compared to the ribose sugar moiety found in DNA and RNA.

Numerous nucleosides with modification of the ribose sugar moiety have been made, primarily with the aim of improving certain properties of oligonucleotides, such as affinity and/or nuclease resistance.

Such modifications include those where the ribose ring structure is modified, e.g. by replacement with a hexose ring (HNA), or a bicyclic ring, which typically have a biradicle bridge between the C2 and C4 carbons on the ribose ring (LNA), or an unlinked ribose ring which typically lacks a bond between the C2 and C3 carbons (e.g. UNA). Other sugar modified nucleosides include, for example, bicyclohexose nucleic acids (WO2011/017521) or tricyclic nucleic acids (WO2013/154798). Modified nucleosides also include nucleosides where the sugar moiety is replaced with a non-sugar moiety, for example in the case of peptide nucleic acids (PNA), or morpholino nucleic acids.

Sugar modifications also include modifications made via altering the substituent groups on the ribose ring to groups other than hydrogen, or the 2'-OH group naturally found in DNA and RNA nucleosides. Substituents may, for example be introduced at the 2', 3', 4' or 5' positions.

2' Sugar Modified Nucleosides

A 2' sugar modified nucleoside is a nucleoside which has a substituent other than H or —OH at the 2' position (2' substituted nucleoside) or comprises a 2' linked biradicle capable of forming a bridge between the 2' carbon and a second carbon in the ribose ring, such as LNA (2'-4' biradicle bridged) nucleosides.

Indeed, much focus has been spent on developing 2' sugar substituted nucleosides, and numerous 2' substituted nucleosides have been found to have beneficial properties when incorporated into oligonucleotides. For example, the 2' modified sugar may provide enhanced binding affinity and/or increased nuclease resistance to the oligonucleotide. Examples of 2' substituted modified nucleosides are 2'-O-alkyl-RNA, 2'-O-methyl-RNA, 2'-alkoxy-RNA, 2'-O-methoxyethyl-RNA (MOE), 2'-amino-DNA, 2'-Fluoro-RNA, and 2'-F-ANA nucleoside. For further examples, please see e.g. Freier & Altmann; Nucl. Acid Res., 1997, 25, 4429-4443 and Uhlmann; Curr. Opinion in Drug Development, 2000, 3(2), 293-213, and Deleavey and Damha, Chemistry and Biology 2012, 19, 937. Below are illustrations of some 2' substituted modified nucleosides.

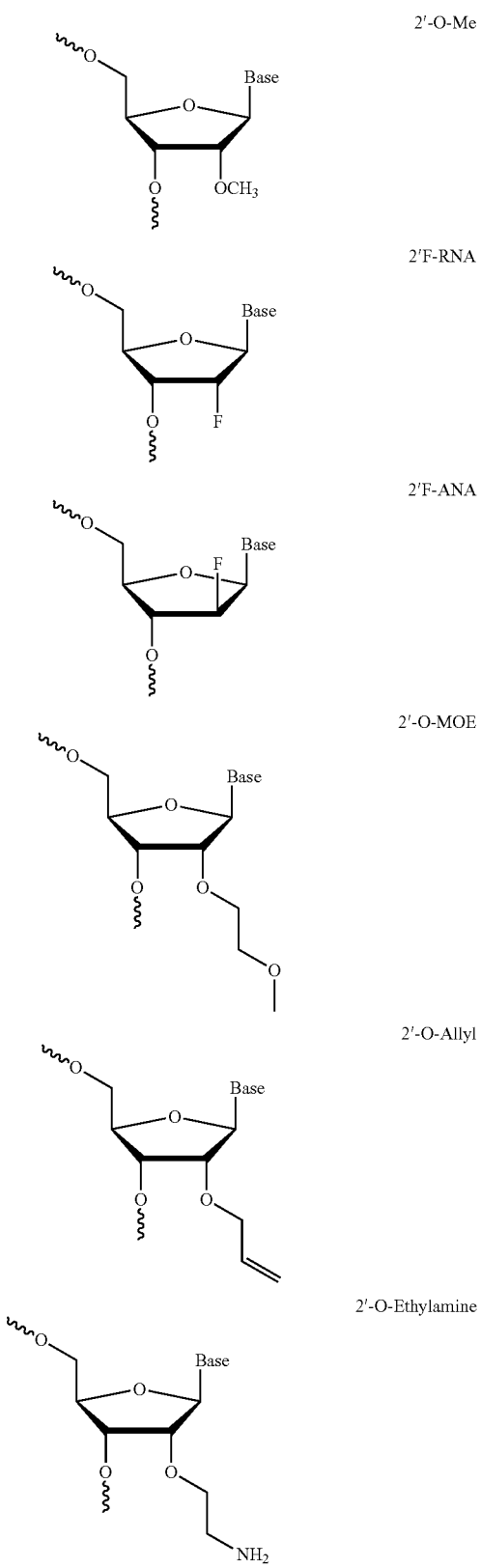

In relation to the present invention 2' substituted sugar modified nucleosides does not include 2' bridged nucleosides like LNA.

Locked Nucleic Acid Nucleosides (LNA Nucleoside)

A "LNA nucleoside" is a 2'-modified nucleoside which comprises a biradical linking the C2' and C4' of the ribose sugar ring of said nucleoside (also referred to as a "2'-4' bridge"), which restricts or locks the conformation of the ribose ring. These nucleosides are also termed bridged nucleic acid or bicyclic nucleic acid (BNA) in the literature. The locking of the conformation of the ribose is associated with an enhanced affinity of hybridization (duplex stabilization) when the LNA is incorporated into an oligonucleotide for a complementary RNA or DNA molecule. This can be routinely determined by measuring the melting temperature of the oligonucleotide/complement duplex.

Non limiting, exemplary LNA nucleosides are disclosed in WO 99/014226, WO 00/66604, WO 98/039352, WO 2004/046160, WO 00/047599, WO 2007/134181, WO 2010/077578, WO 2010/036698, WO 2007/090071, WO 2009/006478, WO 2011/156202, WO 2008/154401, WO 2009/067647, WO 2008/150729, Morita et al., Bioorganic & Med. Chem. Lett. 12, 73-76, Seth et al. J. Org. Chem. 2010, Vol 75(5) pp. 1569-81, and Mitsuoka et al., Nucleic Acids Research 2009, 37(4), 1225-1238, and Wan and Seth, J. Medical Chemistry 2016, 59, 9645-9667.

Further non limiting, exemplary LNA nucleosides are disclosed in Scheme 1.

Scheme 1

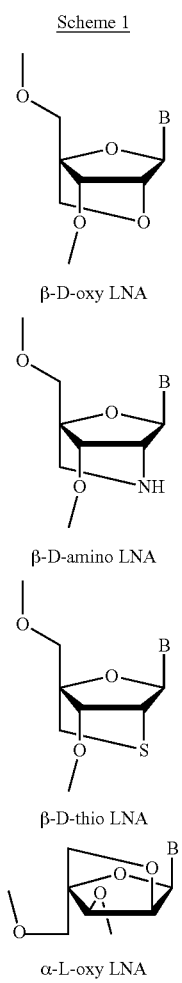

β-D-oxy LNA

β-D-amino LNA

β-D-thio LNA

α-L-oxy LNA

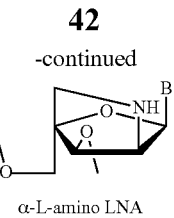

α-L-amino LNA

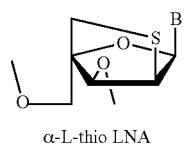

α-L-thio LNA

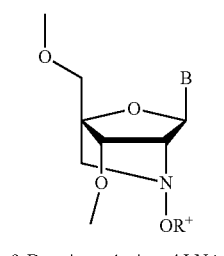

β-D-amino substituted LNA

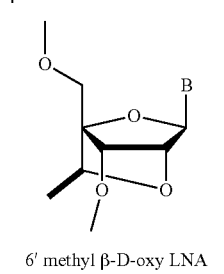

6' methyl β-D-oxy LNA

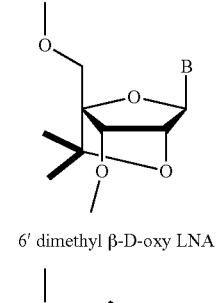

6' dimethyl β-D-oxy LNA

5' methyl β-D-oxy LNA

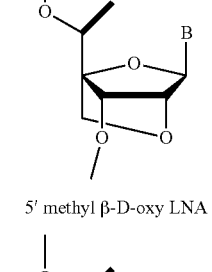

5' methyl, 6' dimethyl β-D-oxy LNA

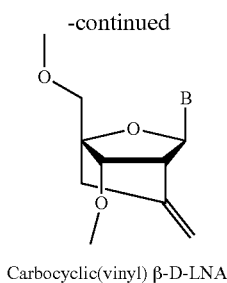

Carbocyclic(vinyl) β-D-LNA

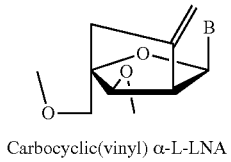

Carbocyclic(vinyl) α-L-LNA

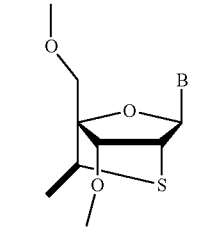

6' methyl thio β-D LNA

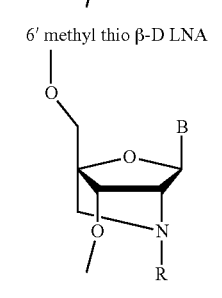

Substituted β-D amino LNA

Particular LNA nucleosides are beta-D-oxy-LNA, 6'-methyl-beta-D-oxy LNA, such as (S)-6'-methyl-beta-D-oxy-LNA (ScET) and ENA.

A particularly advantageous LNA is beta-D-oxy-LNA.

The compounds described herein can contain several asymmetric centers and can be present in the form of optically pure enantiomers, mixtures of enantiomers such as, for example, racemates, mixtures of diastereoisomers, diastereoisomeric racemates or mixtures of diastereoisomeric racemates.

The term "asymmetric carbon atom" means a carbon atom with four different substituents. According to the Cahn-Ingold-Prelog Convention an asymmetric carbon atom can be of the "R" or "S" configuration.

Pharmaceutically Acceptable Salts

The term "pharmaceutically acceptable salts" refers to those salts which retain the biological effectiveness and properties of the free bases or free acids, which are not biologically or otherwise undesirable. The salts are formed with inorganic acids such as hydrochloric acid, hydrobromic acid, sulfuric acid, nitric acid, phosphoric acid, particularly hydrochloric acid, and organic acids such as acetic acid, propionic acid, glycolic acid, pyruvic acid, oxalic acid, maleic acid, malonic acid, succinic acid, fumaric acid, tartaric acid, citric acid, benzoic acid, cinnamic acid, mandelic acid, methanesulfonic acid, ethanesulfonic acid, p-toluenesulfonic acid, salicylic acid, N-acetylcystein. In addition these salts may be prepared form addition of an inorganic base or an organic base to the free acid. Salts derived from an inorganic base include, but are not limited to, the sodium, potassium, lithium, ammonium, calcium, magnesium salts. Salts derived from organic bases include, but are not limited to salts of primary, secondary, and tertiary amines, substituted amines including naturally occurring substituted amines, cyclic amines and basic ion exchange resins, such as isopropylamine, trimethylamine, diethylamine, triethylamine, tripropylamine, ethanolamine, lysine, arginine, N-ethylpiperidine, piperidine, polyamine resins. The compound of formula (I) can also be present in the form of zwitterions. Particularly preferred pharmaceutically acceptable salts of compounds of formula (I) are the salts of hydrochloric acid, hydrobromic acid, sulfuric acid, phosphoric acid and methanesulfonic acid.

Protecting Group

The term "protecting group", alone or in combination, signifies a group which selectively blocks a reactive site in a multifunctional compound such that a chemical reaction can be carried out selectively at another unprotected reactive site. Protecting groups can be removed. Exemplary protecting groups are amino-protecting groups, carboxy-protecting groups or hydroxy-protecting groups.

Nuclease Mediated Degradation

Nuclease mediated degradation refers to an oligonucleotide capable of mediating degradation of a complementary nucleotide sequence when forming a duplex with such a sequence.

In some embodiments, the oligonucleotide may function via nuclease mediated degradation of the target nucleic acid, where the oligonucleotides of the invention are capable of recruiting a nuclease, particularly and endonuclease, preferably endoribonuclease (RNase), such as RNase H. Examples of oligonucleotide designs which operate via nuclease mediated mechanisms are oligonucleotides which typically comprise a region of at least 5 or 6 consecutive DNA nucleosides and are flanked on one side or both sides by affinity enhancing nucleosides, for example gapmers, headmers and tailmers.

RNase H Activity and Recruitment

The RNase H activity of an antisense oligonucleotide refers to its ability to recruit RNase H when in a duplex with a complementary RNA molecule. WO01/23613 provides in vitro methods for determining RNaseH activity, which may be used to determine the ability to recruit RNaseH. Typically an oligonucleotide is deemed capable of recruiting RNase H if it, when provided with a complementary target nucleic acid sequence, has an initial rate, as measured in pmol/l/min, of at least 5%, such as at least 10% or more than 20% of the of the initial rate determined when using a oligonucleotide having the same base sequence as the modified oligonucleotide being tested, but containing only DNA monomers with phosphorothioate linkages between all monomers in the oligonucleotide, and using the methodology provided by Example 91-95 of WO01/23613 (hereby incorporated by reference). For use in determining RHase H activity, recombinant human RNase H1 is available from Lubio Science GmbH, Lucerne, Switzerland.

Gapmer

The antisense oligonucleotide of the invention, or contiguous nucleotide sequence thereof, may be a gapmer, also termed gapmer oligonucleotide or gapmer designs. The antisense gapmers are commonly used to inhibit a target nucleic acid via RNase H mediated degradation. A gapmer oligonucleotide comprises at least three distinct structural regions a 5'-flank, a gap and a 3'-flank, F-G-F' in the '5→3' orientation. The "gap" region (G) comprises a stretch of contiguous DNA nucleotides which enable the oligonucleotide to recruit RNase H. The gap region is flanked by a 5' flanking region (F) comprising one or more sugar modified nucleosides, advantageously high affinity sugar modified nucleosides, and by a 3' flanking region (F') comprising one or more sugar modified nucleosides, advantageously high affinity sugar modified nucleosides. The one or more sugar modified nucleosides in region F and F' enhance the affinity of the oligonucleotide for the target nucleic acid (i.e. are affinity enhancing sugar modified nucleosides). In some embodiments, the one or more sugar modified nucleosides in region F and F' are 2' sugar modified nucleosides, such as high affinity 2' sugar modifications, such as independently selected from LNA and 2'-MOE.

In a gapmer design, the 5' and 3' most nucleosides of the gap region are DNA nucleosides, and are positioned adjacent to a sugar modified nucleoside of the 5' (F) or 3' (F') region respectively. The flanks may further defined by having at least one sugar modified nucleoside at the end most distant from the gap region, i.e. at the 5' end of the 5' flank and at the 3' end of the 3' flank.

Regions F-G-F' form a contiguous nucleotide sequence. Antisense oligonucleotides of the invention, or the contiguous nucleotide sequence thereof, may comprise a gapmer region of formula F-G-F'.

The overall length of the gapmer design F-G-F' may be, for example 12 to 32 nucleosides, such as 13 to 24, such as 14 to 22 nucleosides, Such as from 14 to 17, such as 16 to 18 nucleosides.

By way of example, the gapmer oligonucleotide of the present invention can be represented by the following formulae:

$F_{1-8}$-$G_{6-16}$-$F'_{1-8}$, such as $F_{1-8}$-$G_{8-16}$-$F'_{2-8}$ with the proviso that the overall length of the gapmer regions F-G-F' is at least 12, such as at least 14 nucleotides in length.

In an aspect of the invention the antisense oligonucleotide or contiguous nucleotide sequence thereof consists of or comprises a gapmer of formula 5'-F-G-F'-3', where region F and F' independently comprise or consist of 1-8, such as 2-6, such as 3-4 2' sugar modified nucleosides, wherein there is at least one 2' sugar modified nucleoside positioned at the 3' end of region F (adjacent to a DNA nucleoside of region G), and at least one 2'sugar modified nucleoside positioned at the 5' end of region F' (positioned adjacent to a DNA nucleoside of region G), and G is a region between 6 and 16 nucleosides which are capable of recruiting RNaseH, such as a region of 6-16 DNA nucleosides, such as such as 10-15 contiguous DNA nucleosides, such as 10-14 contiguous DNA nucleotides, such as 11-15 contiguous DNA nucleotides, such as 13-15 contiguous DNA nucleotides.

LNA Gapmer

An LNA gapmer is a gapmer wherein either one or both of region F and F' comprises or consists of LNA nucleosides. A beta-D-oxy gapmer is a gapmer wherein either one or both of region F and F' comprises or consists of beta-D-oxy LNA nucleosides.

In some embodiments the LNA gapmer is of formula: [LNA]$_{1-5}$-[region G]-[LNA]$_{1-5}$, wherein region G is as defined in the Gapmer region G definition.

MOE Gapmers

A MOE gapmers is a gapmer wherein regions F and F' consist of MOE nucleosides. In some embodiments the MOE gapmer is of design [MOE]$_{1-8}$-[Region G]-[MOE]$_{1-8}$, such as [MOE]$_{2-7}$-[Region G]$_{5-16}$-[MOE]$_{2-7}$, such as [MOE]$_{3-6}$-[Region G]-[MOE]$_3$-6, wherein region G is as defined in the Gapmer definition. MOE gapmers with a 5-10-5 design (MOE-DNA-MOE) have been widely used in the art.

Mixed Wing Gapmer

A mixed wing gapmer is an LNA gapmer wherein one or both of region F and F' comprise a 2' substituted nucleoside, such as a 2' substituted nucleoside independently selected from the group consisting of 2'-O-alkyl-RNA units, 2'-O-methyl-RNA, 2'-amino-DNA units, 2'-fluoro-DNA units, 2'-alkoxy-RNA, MOE units, arabino nucleic acid (ANA) units and 2'-fluoro-ANA units, such as a MOE nucleosides. In some embodiments wherein at least one of region F and F', or both region F and F' comprise at least one LNA nucleoside, the remaining nucleosides of region F and F' are independently selected from the group consisting of MOE and LNA. In some embodiments wherein at least one of region F and F', or both region F and F' comprise at least two LNA nucleosides, the remaining nucleosides of region F and F' are independently selected from the group consisting of MOE and LNA. In some mixed wing embodiments, one or both of region F and F' may further comprise one or more DNA nucleosides.

Mixed wing gapmer designs are disclosed in WO2008/049085 and WO2012/109395.

Alternating Flank Gapmers

Flanking regions may comprise both LNA and DNA nucleoside and are referred to as "alternating flanks" as they comprise an alternating motif of LNA-DNA-LNA nucleosides. Gapmers comprising such alternating flanks are referred to as "alternating flank gapmers". "Alternative flank gapmers" are thus LNA gapmer oligonucleotides where at least one of the flanks (F or F') comprises DNA in addition to the LNA nucleoside(s). In some embodiments at least one of region F or F', or both region F and F', comprise both LNA nucleosides and DNA nucleosides. In such embodiments, the flanking region F or F', or both F and F' comprise at least three nucleosides, wherein the 5' and 3' most nucleosides of the F and/or F' region are LNA nucleosides.

An alternating flank region may comprise up to 3 contiguous DNA nucleosides, such as 1 to 2 or 1 or 2 or 3 contiguous DNA nucleosides.

Region D' or D" in an Oligonucleotide

The oligonucleotide of the invention may in some embodiments comprise or consist of the contiguous nucleotide sequence of the oligonucleotide which is complementary to the target nucleic acid, such as the gapmer F-G-F', and further 5' and/or 3' nucleosides. The further 5' and/or 3' nucleosides may or may not be fully complementary to the target nucleic acid. Such further 5' and/or 3' nucleosides may be referred to as region D' and D" herein.

The addition of region D' or D" may be used for the purpose of joining the contiguous nucleotide sequence, such as the gapmer, to a conjugate moiety or another functional group. When used for joining the contiguous nucleotide sequence with a conjugate moiety is can serve as a biocleavable linker. Alternatively it may be used to provide exonuclease protection or for ease of synthesis or manufacture.

Region D' and D" can be attached to the 5' end of region F or the 3' end of region F', respectively to generate designs of the following formulas D'-F-G-F', F-G-F'-D" or D'-F-G-F'-D". In this instance the F-G-F' is the gapmer portion of the oligonucleotide and region D' or D" constitute a separate part of the oligonucleotide.

Region D' or D" may independently comprise or consist of 1, 2, 3, 4 or 5 additional nucleotides, which may be complementary or non-complementary to the target nucleic acid. The nucleotide adjacent to the F or F' region is not a sugar-modified nucleotide, such as a DNA or RNA or base modified versions of these. The D' or D' region may serve as a nuclease susceptible biocleavable linker (see definition of linkers). In some embodiments the additional 5' and/or 3' end nucleotides are linked with phosphodiester linkages, and are DNA or RNA. Nucleotide based biocleavable linkers suitable for use as region D' or D" are disclosed in WO2014/076195, which include by way of example a phosphodiester linked DNA dinucleotide. The use of biocleavable linkers in poly-oligonucleotide constructs is disclosed in WO2015/113922, where they are used to link multiple antisense constructs (e.g. gapmer regions) within a single oligonucleotide.

In one embodiment the oligonucleotide of the invention comprises a region D' and/or D" in addition to the contiguous nucleotide sequence which constitutes the gapmer.

In some embodiments, the oligonucleotide of the present invention can be represented by the following formulae:

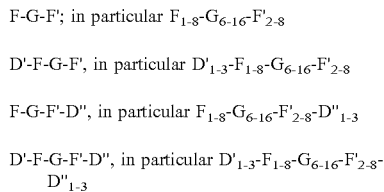

F-G-F'; in particular $F_{1-8}$-$G_{6-16}$-$F'_{2-8}$

D'-F-G-F', in particular $D'_{1-3}$-$F_{1-8}$-$G_{6-16}$-$F'_{2-8}$

F-G-F'-D", in particular $F_{1-8}$-$G_{6-16}$-$F'_{2-8}$-$D''_{1-3}$

D'-F-G-F'-D", in particular $D'_{1-3}$-$F_{1-8}$-$G_{6-16}$-$F'_{2-8}$-$D''_{1-3}$ In some embodiments the internucleoside linkage positioned between region D' and region F is a phosphodiester linkage. In some embodiments the internucleoside linkage positioned between region F' and region D" is a phosphodiester linkage.

Conjugate

The term conjugate as used herein refers to an oligonucleotide which is covalently linked to a non-nucleotide moiety (conjugate moiety or region C or third region).

Conjugation of the oligonucleotide of the invention to one or more non-nucleotide moieties may improve the pharmacology of the oligonucleotide, e.g. by affecting the activity, cellular distribution, cellular uptake or stability of the oligonucleotide. In some embodiments the conjugate moiety modify or enhance the pharmacokinetic properties of the oligonucleotide by improving cellular distribution, bioavailability, metabolism, excretion, permeability, and/or cellular uptake of the oligonucleotide. In particular the conjugate may target the oligonucleotide to a specific organ, tissue or cell type and thereby enhance the effectiveness of the oligonucleotide in that organ, tissue or cell type. A the same time the conjugate may serve to reduce activity of the oligonucleotide in non-target cell types, tissues or organs, e.g. off target activity or activity in non-target cell types, tissues or organs.

In an embodiment, the non-nucleotide moiety (conjugate moiety) is selected from the group consisting of carbohydrates, cell surface receptor ligands, drug substances, hormones, lipophilic substances, polymers, proteins, peptides, toxins (e.g. bacterial toxins), vitamins, viral proteins (e.g. capsids) or combinations thereof.

Linkers

A linkage or linker is a connection between two atoms that links one chemical group or segment of interest to another chemical group or segment of interest via one or more covalent bonds. Conjugate moieties can be attached to the oligonucleotide directly or through a linking moiety (e.g. linker or tether). Linkers serve to covalently connect a third region, e.g. a conjugate moiety (Region C), to a first region, e.g. an oligonucleotide or contiguous nucleotide sequence complementary to the target nucleic acid (region A).

In some embodiments of the invention the conjugate or oligonucleotide conjugate of the invention may optionally, comprise a linker region (second region or region B and/or region Y) which is positioned between the oligonucleotide or contiguous nucleotide sequence complementary to the target nucleic acid (region A or first region) and the conjugate moiety (region C or third region).

Region B refers to biocleavable linkers comprising or consisting of a physiologically labile bond that is cleavable under conditions normally encountered or analogous to those encountered within a mammalian body. Conditions under which physiologically labile linkers undergo chemical transformation (e.g., cleavage) include chemical conditions such as pH, temperature, oxidative or reductive conditions or agents, and salt concentration found in or analogous to those encountered in mammalian cells. Mammalian intracellular conditions also include the presence of enzymatic activity normally present in a mammalian cell such as from proteolytic enzymes or hydrolytic enzymes or nucleases. In one embodiment the biocleavable linker is susceptible to S1 nuclease cleavage. In a preferred embodiment the nuclease susceptible linker comprises between 1 and 10 nucleosides, such as 1, 2, 3, 4, 5, 6, 7, 8, 9 or 10 nucleosides, more preferably between 2 and 6 nucleosides and most preferably between 2 and 4 linked nucleosides comprising at least two consecutive phosphodiester linkages, such as at least 3 or 4 or 5 consecutive phosphodiester linkages. Preferably the nucleosides are DNA or RNA. Phosphodiester containing biocleavable linkers are described in more detail in WO 2014/076195 (hereby incorporated by reference)—see also region D' or D" herein. Region Y refers to linkers that are not necessarily biocleavable but primarily serve to covalently connect a conjugate moiety (region C or third region), to an oligonucleotide (region A or first region). The region Y linkers may comprise a chain structure or an oligomer of repeating units such as ethylene glycol, amino acid units or amino alkyl groups The oligonucleotide conjugates of the present invention can be constructed of the following regional elements A-C, A-B-C, A-B-Y-C, A-Y-B-C or A-Y-C. In some embodiments the linker (region Y) is an amino alkyl, such as a C2-C36 amino alkyl group, including, for example C6 to C12 amino alkyl groups. In a preferred embodiment the linker (region Y) is a C6 amino alkyl group.

Treatment

The term 'treatment' as used herein refers to both treatment of an existing disease (e.g. a disease or disorder as herein referred to), or prevention of a disease, i.e. prophylaxis. It will therefore be recognized that treatment as referred to herein may, in some embodiments, be prophylactic.

In some embodiments treatment is performed on a subject who is suffering chronic pain, or is expected to suffer chromic pain (prophylactic treatment).

DETAILED DESCRIPTION OF THE INVENTION

The Oligonucleotides of the Invention

The invention relates to oligonucleotides capable of inhibiting the of voltage-gated sodium ion channel encoding nucleic acids, such as SCN9A or SCN10A, or both SCN9A and SCN10A.

The invention relates to oligonucleotides capable of inhibiting the expression of voltage-gated sodium ion channels, such as Nav1.7 or Nav1.8 or both Nav1.7 or Nav1.8. Oligonucleotides targeting both Nav1.7 and Nav1.8 (or optionally Nav1.9) may be designed by selecting the regions of identity or high sequence similarity between the SCN9A and SCN10A transcripts (or optionally SCN11A). In some embodiments the oligonucleotide of the invention may target both SCN9A and SCN10A transcripts, wherein the contiguous nucleotide sequence of the oligonucleotide is either fully complementary to one of SCN9A and SCN10A transcripts, and has no more than a single mismatch to the other of SCN9A and SCN10A transcript. In some embodiments, the contiguous nucleotide sequence comprises a single mismatch to both SCN9A and SCN10A transcript at the same position in the contiguous nucleotide sequence. In some embodiments it is useful to include a universal base at the site of a mismatch against one of, or both of SCN9A and SCN10A transcripts.

In some embodiments the oligonucleotide of the invention may target both SCN9A and SCN10A transcripts, wherein the contiguous nucleotide sequence of the oligonucleotide is either fully complementary to one of SCN9A and SCN11A transcripts, and has no more than a single mismatch to the other of SCN9A and SCN11A transcript. In some embodiments, the contiguous nucleotide sequence comprises a single mismatch to both SCN9A and SCN11A transcript at the same position in the contiguous nucleotide sequence. In some embodiments it is useful to include a universal base at the site of a mismatch against one of, or both of SCN9A and SCN11A transcripts.

In some embodiments the oligonucleotide of the invention may target SCN9A and SCN10A and SCN11A transcripts, wherein the contiguous nucleotide sequence of the oligonucleotide is either fully complementary to one of SCN9A, SCN10A and SCN11A transcripts, and has no more than a single mismatch to the others of SCN9A, SCN10A and SCN11A transcripts. The human SCN11A pre-mRNA transcript is disclosed as ENSG00000168356 (Ensembl version ENSG00000168356.11).

The modulation may be achieved by hybridizing to a target nucleic acid encoding the voltage-gated sodium ion channels. The target nucleic acid may be a mammalian SCN9A or SCN10A sequence, such as a sequence selected from the group consisting of SEQ ID NO: 1, 2, and 3.

The oligonucleotide of the invention is an antisense oligonucleotide which targets SCN9A or SCN10A. The antisense oligonucleotide is complementary to a target sequence present in the target nucleic acid. Suitable target regions are disclosed herein (see for example Target Sequence Lists 1, 2, 3, & 4).

Certain illustrated target sequences are SEQ ID NOs 17-49.

In some embodiments the contiguous nucleotide sequence of the antisense oligonucleotide is at least 90% complementary to, such as fully complementary to an intron region of the SCN9A target nucleic acid sequence such as a target sequence selected 11-126 of SEQ ID NO 1.

In some embodiments the contiguous nucleotide sequence of the antisense oligonucleotide is at least 90% complementary to, such as fully complementary to an exon region of the SCN9A target nucleic acid sequence such as a target sequence selected E1-E27 of SEQ ID NO 1.

Contiguous Nucleotide Sequences

In some embodiments, the antisense oligonucleotides of the invention comprises a contiguous nucleotide sequence selected from the group consisting of SEQ ID NO 50-641.

In some embodiments, the antisense oligonucleotides of the invention comprises a contiguous nucleotide sequence of at least 12 nucleotides in length which are identical to a sequence selected from the group consisting of SEQ ID NO 50-641.

In some embodiments, the antisense oligonucleotides of the invention comprises a contiguous nucleotide sequence of at least 14 nucleotides in length which are identical to a sequence selected from the group consisting of SEQ ID NO 50-641.

In determining identity, unless otherwise specified fully identity is meant, and identity of the antisense oligonucleotides of the invention which comprises a contiguous nucleotide sequence which is identical to a sequence selected from the group consisting of SEQ ID NO 50-641, is measured across the length of the contiguous nucleotide sequence. In some embodiments the contiguous nucleotide sequence of the antisense oligonucleotide of the invention comprises a sequence selected from the group consisting of SEQ ID NO 50-641.

It will be understood that the antisense oligonucleotide may comprise a modified base where a unmodified base is indicated in the reference sequence—for example a U base may be used in place of a T, and 5-methyl cytosine may be used in place of a C.

| SEQID | Contiguous Nucleotide Sequence |
|---|---|
| 50 | ATGTTTACTATAATCACA |
| 51 | GGCATATCATATATCC |
| 52 | CCAATTTTTTCTTAAAATAT |
| 53 | TCTCATAAATCCTCATAT |
| 54 | TATTCTACCCACATTCT |
| 55 | AGTATTCTACCCACATT |
| 56 | AAGTATTCTACCCACAT |
| 57 | TATCTCATATTCCACAAA |
| 58 | TTATCTCATATTCCACA |
| 59 | GTTATCTCATATTCCAC |
| 60 | TTCAATGAAGAAATTTCA |
| 61 | GCTCAATTTTCCAATTATT |
| 62 | TCTAATCTTATTTATCTTTC |
| 63 | TCCCATAATATTTACCTA |
| 64 | ATCACTTCAACTTTATAATA |
| 65 | TTCATCACTTCAACTTTA |
| 66 | TCCTACCTGAATTACC |
| 67 | GCTTTTAACACTTTATA |
| 68 | CTCCTAATATATAATATACT |
| 69 | TCTCCTAATATATAATATA |
| 70 | ATATATCTCCTAATATATA |
| 71 | ACATATATATCTCCTAATA |
| 72 | CTCATATCTACTTATCAT |
| 73 | TACTCATATCTACTTATCA |
| 74 | TCTACTCATATCTACTTA |
| 75 | ACATCTACTCATATCTACT |

-continued

| SEQID | Contiguous Nucleotide Sequence |
|---|---|
| 76 | AATTACACCATTCCTCT |
| 77 | CCCTTTTAATTACACCAT |
| 78 | ACACTATTATACATTCCCA |
| 79 | AGCTACACTATTATACAT |
| 80 | ACTTCCATATTATTTTCCAT |
| 81 | TCTCCTTAAATACATCAAAT |
| 82 | ATATTACTGTACTCCC |
| 83 | ATATTTATACAACAACTCA |
| 84 | TAGTCACCATTTTTCAT |
| 85 | AGAAAATAATTCCTATCCT |
| 86 | ATACATGTATCCACTTC |
| 87 | TTCCAATATTATTATACA |
| 88 | ACCCTTATTTAAATAATTA |
| 89 | TCACGTTAAATCCCATCT |
| 90 | ACGTTAAATCCCATC |
| 91 | TTCACGTTAAATCCCA |
| 92 | GGATATCGTATTTTCT |
| 93 | TCTGGATATCGTATT |
| 94 | GATATATTATCCATCTCA |
| 95 | TGATATATTATCCATCT |
| 96 | AGCATCTACATTTTAATT |
| 97 | TCTTAATTCTTATCATTTTA |
| 98 | AACTTCTTAATTCTTATCA |
| 99 | TACAATAATTATCTTCTCA |
| 100 | TGCAAATAATACCCTAT |
| 101 | CTCTATTCTAAATAAACCTT |
| 102 | ACTCTATTCTAAATAAACC |
| 103 | ATGACTCTATTCTAAATA |
| 104 | TAAGCATATATTTTCCCA |
| 105 | TCATTTCCATTAAATCCAA |
| 106 | TTTCATTTCCATTAAATCC |
| 107 | TTTTATCCTACTTCTAC |
| 108 | TCCCTCAAATATAAATTC |
| 109 | ACTGTTTTCTCTAAACC |
| 110 | AGATTCACTACATCCA |
| 111 | GCACTCTGATTACATTTCCT |
| 112 | TATTTAATCACTTTATCTAA |
| 113 | ATATTTAATCACTTTATCT |

-continued

| SEQID | Contiguous Nucleotide Sequence |
|---|---|
| 114 | ATCAACCACACAATTACTTT |
| 115 | TATCAACCACACAATTACTT |
| 116 | TTATCAACCACACAATTAC |
| 117 | TCAATAAAATTCCTTATACT |
| 118 | TCATTTTATTTATTTCAATT |
| 119 | TATACACTCTTTCTCTATTC |
| 120 | TGACCATCTTATTCATC |
| 121 | CCTGATACTCATTCCCA |
| 122 | TTTCTCTTTATCTTTTATC |
| 123 | AAATCAACCCTAAACCC |
| 124 | AAAGTACCATTTACTCCC |
| 125 | TTCATATACTCTTATTTTA |
| 126 | CTAATTTTTCATATACTCTT |
| 127 | TCTAATTTTTCATATACTC |
| 128 | CTCTAATTTTTCATATACT |
| 129 | ACATTTTTCCTACAAACTA |
| 130 | CTACTATTCCATCATTTTT |
| 131 | CAATTACACCTACAACTTC |
| 132 | TCCAATTACACCTACAAC |
| 133 | GCCTTAATCAATTTCTCAA |
| 134 | CACTTTCCAATATTACT |
| 135 | TTACACTTTCCAATATTAC |
| 136 | CATTACACTTTCCAATATTA |
| 137 | ACATTACACTTTCCAATA |
| 138 | ATATACCCCAATTACTCCA |
| 139 | ATACTAGCAATTCATCA |
| 140 | ATACCATTAACTATCACC |
| 141 | AGATACCATTAACTATCA |
| 142 | CCCATCTTCATTATATTA |
| 143 | TTCTGATCTCTCTTATA |
| 144 | ATTTCATTCAGGAAATAC |
| 145 | TCATTTCATCAATAACATTA |
| 146 | TTGCTTTTTACTAACA |
| 147 | GTTTCATTTCTTTATTAT |
| 148 | GCTATTATATTACTTTT |
| 149 | GTCCTCTAATCATATCACA |
| 150 | TAGTCCTCTAATCATATC |
| 151 | TTAGTCCTCTAATCATA |

-continued

| SEQID | Contiguous Nucleotide Sequence |
|---|---|
| 152 | ACTTAGTCCTCTAATCA |
| 153 | TAAATAAAACAATCCCCA |
| 154 | TAATTAAATAAACAATCCC |
| 155 | ATACATACCTCTATTATT |
| 156 | TCAATACATACCTCTATTA |
| 157 | CTCAATACATACCTCTATT |
| 158 | GAACTCAATACATACCTC |
| 159 | AGAACTCAATACATACC |
| 160 | TGAATTTTATTCCCTTC |
| 161 | ACACAATACCATATTTCA |
| 162 | TGCTATAATATTTTATCT |
| 163 | ACAAACTTTCAATACTCTA |
| 164 | TCTTCTACACTATTATTC |
| 165 | ATATCTTCTACACTATTATT |
| 166 | TATATCTTCTACACTATTA |
| 167 | TTATATCTTCTACACTA |
| 168 | AGCTCATTTCCTATAC |
| 169 | TACTTTTTTTCTATCCAA |
| 170 | TCTACTTTTTTTCTATC |
| 171 | TTTATTAATTTACTCCTT |
| 172 | ATTTTATTAATTTACTCC |
| 173 | ACCAATACCATAAATTCCA |
| 174 | ATTAATATTTTTTCTCCAT |
| 175 | TTTATTAATATTTTTTCTCC |
| 176 | TCCTTTTATTAATATTTTTT |
| 177 | CCTCCTTTTATTAATATT |
| 178 | GCCTCCTTTTATTAATAT |
| 179 | TAACATATCTACCATCTC |
| 180 | AATCCCTTACCATTATT |
| 181 | ACAGCTTCATTTAACTA |
| 182 | TTAACCAAATCTATACACT |
| 183 | TTAGACTAACCATCCTA |
| 184 | TATTAGACTAACCATCC |
| 185 | ACCTCATAATACTTTTC |
| 186 | TACCTGATAACATCTTT |
| 187 | TTACTAATCTAAATACCT |
| 188 | TCTCATTTTACTAATCTA |
| 189 | TTCTCATTTTACTAATCT |
| 190 | AACCAAGTCTATATCCA |
| 191 | TCACCTTCATAACTTATC |
| 192 | ATTTTAAATTACTCTCCTAT |
| 193 | ATATTTAAATTACTCTCCT |
| 194 | AGTACAATTTAACTCCCT |
| 195 | ATTATCTATAATATACCTA |
| 196 | TCCATAAATCTATTCCAA |
| 197 | TTCCATAAATCTATTCCA |
| 198 | TTTCCATAAATCTATTCC |
| 199 | AGCAAATAAATTCCAACAC |
| 200 | TCATGCTTCCATAATTA |
| 201 | CCTTTCCCATTACAATTT |
| 202 | ACATGATACTTAATACC |
| 203 | CAACAATATCAATCTTCC |
| 204 | TTATTAATATTTCTTCTTCA |
| 205 | TCAGTTAATCATCTCAC |
| 206 | TTGCCATTAAAATTTCC |
| 207 | GATGAACAGACCAAACT |
| 208 | ATCCATACATCCTAAAAT |
| 209 | CTCATCCATACATCCTA |
| 210 | GTCCAAATATCATATCAT |
| 211 | TGTCCAAATATCATATC |
| 212 | ACCATTAATCTCATATT |
| 213 | TCACCATTAATCTCATAT |
| 214 | CACCATTAATCTCATA |
| 215 | ATCAATCAATATTTATTCTT |
| 216 | ATACTTTACTTTTCAAATTT |
| 217 | TATACTTTACTTTTCAAATT |
| 218 | CTTTATACTTTACTTTTCAA |
| 219 | TCTTTATACTTTACTTTTCA |
| 220 | CCAATATTCCTATTCTC |
| 221 | TGTAACCACTCTTATCAAT |
| 222 | AATGTAACCACTCTTATC |
| 223 | TTCCAATTTCCTATTAAT |
| 224 | CATTCCAATTTCCTATTA |
| 225 | AAATTTTCCTAAATTCCCC |
| 226 | TTCACTAATCTCAATTTA |
| 227 | ACTAAATTTCACTAATCTCA |

| SEQID | Contiguous Nucleotide Sequence |
|---|---|
| 228 | TTATTCACTAAATTTCACT |
| 229 | TGCTAAACAATTATACTA |
| 230 | AATTATTCATCCATTCTTTC |
| 231 | ATCAATTTTTCACATCAATA |
| 232 | TTATACCCACTTACTC |
| 233 | GTACTTATACCCACTTAC |
| 234 | ATGTACTTATACCCACTT |
| 235 | TGTACTTATACCCACT |
| 236 | AAATGTACTTATACCCAC |
| 237 | CATCTAATTTTTCTAATCT |
| 238 | TTATAAAACATACACCCA |
| 239 | ATTATAAAACATACACCC |
| 240 | CTTCTATCAAAAATTCACC |
| 241 | CAAAAGTATATATTCCA |
| 242 | TACGCAAAAACAATGAC |
| 243 | TTACGCAAAAACAATG |
| 244 | TACTTACGCAAAAACA |
| 245 | CAGCTCTTTTACAAATAT |
| 246 | TCTATGACATTACCT |
| 247 | ACACCAATTACTTCTTACC |
| 248 | CACACCAATTACTTCTTAC |
| 249 | TTCACACCAATTACTTCTTA |
| 250 | GCTTCACACCAATTACTTC |
| 251 | CCTAATGCTTCACACC |
| 252 | ACAACTCCCAAATAGTT |
| 253 | AAATTTAATTAAAATTGC |
| 254 | ATGCATTATATCAAATCA |
| 255 | AAAACACAAGCTTTCCTA |
| 256 | TCATCCAATATTCATCA |
| 257 | ATATTACTTTTTATTATCTA |
| 258 | GCTAAATTCCTCATCAAAT |
| 259 | TGCTAAATTCCTCATCAAA |
| 260 | ATATGCTAAATTCCTCATCA |
| 261 | ATGCTAAATTCCTCATC |
| 262 | TATGCTAAATTCCTCAT |
| 263 | GAAAATATGCTAAATTCCT |
| 264 | TGCAATCTAACTTCATA |
| 265 | CTTGATTTAAACACCTCT |
| 266 | ACTTGATTTAAACACCT |
| 267 | GCTTCTTACTATCTTTTA |
| 268 | GTCTTCTTTAATCCATCA |
| 269 | CTATATTATATATCCACCT |
| 270 | CTCTATATTATATATCCAC |
| 271 | TCTCTATATTATATATCCA |
| 272 | ATTCTCTATATTATATATCC |
| 273 | CCAATTCTCTATATTATAT |
| 274 | TCCAATTCTCTATATTATA |
| 275 | TCTCCAATTCTCTATATTAT |
| 276 | ATCTCCAATTCTCTATATTA |
| 277 | AATCTCCAATTCTCTATATT |
| 278 | TAAATCTCCAATTCTCTATA |
| 279 | GAATTTATCTCCAAACTCA |
| 280 | TGTCTACACATATTACC |
| 281 | TGATCCCATCTTATAC |
| 282 | TATATTTCTCCATAATAC |
| 283 | TATTCCTCAATAAACCTA |
| 284 | GACTTCCTATTTTACTCA |
| 285 | TTTCTCATATATTCTCCC |
| 286 | TTTTCTCATATATTCTCC |
| 287 | CTATTTTCTCATATATTCT |
| 288 | TTTACTATTTTCTCATATAT |
| 289 | TTACTATTTTCTCATATA |
| 290 | AACAAATATTACATACCCT |
| 291 | TGCCATTAAATAAATACA |
| 292 | TGCCATTCAAAAATACAAT |
| 293 | TAATATACTTTTATCATACA |
| 294 | ATTACTTTATTCATCTCAT |
| 295 | TAATTACTTTATTCATCTCA |
| 296 | TTAATTACTTTATTCATCTC |
| 297 | TTTAATTACTTTATTCATCT |
| 298 | ATTTAATTACTTTATTCATC |
| 299 | TTCTATCTTTTCTTTCTTTA |
| 300 | CATGCATTTTTTCCTACA |
| 301 | GAAATTCTAATTCTTTCT |
| 302 | AACATCTGTTGAAATTCT |
| 303 | ATTTAATCCATCATTATTCT |

| SEQID | Contiguous Nucleotide Sequence |
|---|---|
| 304 | TAACTCCATATCATCAATA |
| 305 | ATTAACTCCATATCATCAA |
| 306 | AATTAACTCCATATCATCA |
| 307 | TTTACCTAAAATCATACCA |
| 308 | TTATATATCAATCCCCA |
| 309 | TTTTATATATCAATCCCC |
| 310 | TTTTTATATATCAATCCC |
| 311 | CTAAAAAGACTTGTTCT |
| 312 | ACTAAAAAGACTTGTTC |
| 313 | CCTTATCTATTATCACC |
| 314 | GCCTTATCTATTATCAC |
| 315 | TTGCCTTATCTATTATC |
| 316 | TCCTTACGCTGTCATCA |
| 317 | TAATCCAAATTTCTTCATA |
| 318 | CTTTCAAGCCTAATCA |
| 319 | TGTTTTCATATAAACCAT |
| 320 | GATTATTACATACCTTCCA |
| 321 | TATCTTTACCATCATTTAA |
| 322 | GTTATCTTTACCATCATT |
| 323 | AGACTTACCAAATTTCC |
| 324 | GAACATGTTGACTCAC |
| 325 | AGTTTTAATACCATTTCA |
| 326 | CAGTTTTAATACCATTTC |
| 327 | ATAATTTATCCTTAATTCT |
| 328 | TCAATGTTTCCAATCTT |
| 329 | CATCTGGTTACATACCACC |
| 330 | ATCACAAAATAATTTCCAC |
| 331 | CATCACAAAATAATTTCCA |
| 332 | TCATCACAAAATAATTTCC |
| 333 | TAGATCACATCATCACAA |
| 334 | CCTAAATACCTTTCTTTTCA |
| 335 | ATACCTAAATACCTTTCTT |
| 336 | CCCTAAATAATACCTAAACA |
| 337 | TCCACCCTAAATAATACC |
| 338 | AGTTAACACTAATTCTACA |
| 339 | GTCTCTAATATTTCTATA |
| 340 | TAGCATTCATCTATCATT |
| 341 | CCTAGCATTCATCTATC |
| 342 | GTTTCACATAATTTATTCC |
| 343 | TTAGAATAAATTCACG |
| 344 | TAATTTCTCAAAAAATTAAA |
| 345 | CCTTCATTATTTCTCAATT |
| 346 | CACAACCATCACTATTTC |
| 347 | TTATTACAATCTATTTTACA |
| 348 | CACTCAATTCCATACTTAT |
| 349 | ACTCAATTCCATACTTA |
| 350 | TCTCTTTTAAATTCAATCT |
| 351 | TATCTCTTTTAAATTCAATC |
| 352 | GCTATCTCTTTTAAATTCA |
| 353 | GTAATTTATCAATTTCCA |
| 354 | AATCTTTTCTTAATCTTTTA |
| 355 | GTACAATACCATTACAACA |
| 356 | CAGTTTTACTTTTCAATA |
| 357 | ATCAATTCTACTTAATACA |
| 358 | TATTCTTATTTTCATATATA |
| 359 | ATATTCTTATTTTCATATA |
| 360 | AATGATCAATCACCCTT |
| 361 | TTGATCTACTTAATTTA |
| 362 | AGTCCCATAACTAACA |
| 363 | TATCACTTATTCATTCATA |
| 364 | TTATCCATCTTTTAATTTA |
| 365 | ATATCTTTCCATATTTTTCA |
| 366 | GGTAACAACTTTTAAATA |
| 367 | CTAGTATACAACATCATA |
| 368 | ACCTAGTATACAACATC |
| 369 | ACCACATTAAATTCTCAAT |
| 370 | TTACAACTTTATCTTTTTA |
| 371 | ACAACCTATACCCTAT |
| 372 | AGGACAACCTATACCC |
| 373 | TGATCTTTCTATCTACAC |
| 374 | TTGATCTTTCTATCTACA |
| 375 | AGCCTTATTTAATAATC |
| 376 | TGTCTTTATTTTCCAATC |
| 377 | TGTTTCCATAATATTTCT |
| 378 | CCATATACCTTCTCCAT |
| 379 | TTTCCATATACCTTCTC |

| SEQID | Contiguous Nucleotide Sequence |
|---|---|
| 380 | TCTTTTCCATATACCTTC |
| 381 | CACTATACAAAACTCTACCA |
| 382 | ACCCTCACTATACAAAC |
| 383 | CACCCTCACTATACAAA |
| 384 | AGCACAATATAAAACCAC |
| 385 | TTAACATTATCTTTCCAA |
| 386 | CTAGCACTTTAATTTCCA |
| 387 | GAATCTCTTCTTAACTCT |
| 388 | AAATAAATGACTATAACT |
| 389 | ACACCTTTCTAAACAATA |
| 390 | AGTCTTTAAACCACTTTC |
| 391 | ACCAAATAATTTCAACACC |
| 392 | TCCCTCAACCAAATAATTT |
| 393 | TCCACCAGATTTTTCC |
| 394 | AAGCTTTCAAACCAAC |
| 395 | TTATCCTAAAACTACCAT |
| 396 | AAGCACCTCATATCTTC |
| 397 | TTACCACTCATTTATTTCT |
| 398 | AGTTACCACTCATTTAT |
| 399 | TACTCTAAAATTATCCTTA |
| 400 | CAGATTCTTCTTATTCTA |
| 401 | GTTCTAATATTCCTCACA |
| 402 | CTCTTATCTTCCAATTTTA |
| 403 | TCTATAATTTCTTCTTATTT |
| 404 | CTTCTATAATTTCTTCTTA |
| 405 | TCCTTCTATAATTTCTTCTT |
| 406 | ATTCCTTCTATAATTTCTT |
| 407 | CATTCCTTCTATAATTTCT |
| 408 | ACATTCCTTCTATAATTTC |
| 409 | GCCATATCTCTTAATTTAA |
| 410 | AGCCATATCTCTTAATT |
| 411 | ACAGCCATATCTCTTAA |
| 412 | TAAGTTTCAAATAACCC |
| 413 | TCCATTATTTTCCACTTA |
| 414 | ACATCCATTATTTTCCAC |
| 415 | TCACATCCATTATTTTCCA |
| 416 | TTCACATCCATTATTTTC |
| 417 | TCATTCACATCCATTATTT |

| SEQID | Contiguous Nucleotide Sequence |
|---|---|
| 418 | TTATATATTTATCTATTTCA |
| 419 | AGCAATACAATCAATACA |
| 420 | CCACAATTACCATAACC |
| 421 | CACCAAAGATCTACCAA |
| 422 | TATTTTCTTACCCTCATT |
| 423 | AGTATTTTCTTACCCTCA |
| 424 | TAGTATTTTCTTACCCT |
| 425 | TTAGTATTTTCTTACCCC |
| 426 | TTATAATTCCACTTACTTT |
| 427 | GTTATAATTCCACTTACT |
| 428 | TAGTTATAATTCCACTTA |
| 429 | TTTAGTTATAATTCCAC |
| 430 | GTTTTCTCAAATATAATT |
| 431 | GAATTCTAATACCACCTT |
| 432 | ATATACTAAACTATTCTCC |
| 433 | TTCATTTATCCTTCAAAATA |
| 434 | TTCATTATTTCATTTATCCT |
| 435 | TTTAATCCTTTCTTTATTTC |
| 436 | CAGTTTTCTTTAATCCT |
| 437 | ATGATCCTATTATTACCA |
| 438 | TTGACTAACATTCATAA |
| 439 | TTCCATCGCACATTTT |
| 440 | ACATAACCTTTTATTTTTA |
| 441 | CATTCTAAATCTTAGTC |
| 442 | ATAATCGTCCATCCCTT |
| 443 | TCACATAAACTCATCCAA |
| 444 | TTCACATAAACTCATCC |
| 445 | ACTTATTTCACATAAACTC |
| 446 | CTTCAAATAACTACAAAG |
| 447 | TGTATTCATTACATACT |
| 448 | ACTCTTAACAATTTATTCA |
| 449 | TCACTCTTAACAATTTATTC |
| 450 | TAACATAATCACTCTTAACA |
| 451 | CCAGAACCTATTATTTA |
| 452 | ATTATTCAATCCTCTATA |
| 453 | TAACCTTCATCACATACT |
| 454 | ATCTAACCTTCATCACATAC |
| 455 | TCTAACCTTCATCACATA |

| SEQID | Contiguous Nucleotide Sequence |
|---|---|
| 456 | CTCTATCTAACCTTCATC |
| 457 | TGACTCTATCTAACCTTC |
| 458 | CCTCTTTTATCAACACAATT |
| 459 | TCTCCAAATCTTAAATTTC |
| 460 | TTTACTATTTCTCCAAATC |
| 461 | TCTTTTACTATTTCTCCAAA |
| 462 | CATCTTTTACTATTTCTCCA |
| 463 | TCATCTTTTACTATTTCTC |
| 464 | CCTCATCTTTTACTATTT |
| 465 | AACCTCATCTTTTACTA |
| 466 | TTTTTATATCTACTCTCA |
| 467 | TTAATAAACATCAATCTCC |
| 468 | ATATTTCCTATTCTCCATT |
| 469 | CATACTGCTCTTTCTA |
| 470 | ATGCAAATAACTTCATCA |
| 471 | TTTAACTTTCTTACCACAA |
| 472 | TTAACTTTCTTACCACA |
| 473 | CATATTCATCTCACCTAC |
| 474 | TCATATTCATCTCACCTA |
| 475 | TTCATATTCATCTCACCT |
| 476 | AATTTTCATATTCATCTCAC |
| 477 | CTACCTTTTTAATTCTAAAT |
| 478 | ACTACCTTTTTAATTCTA |
| 479 | TGACTACCTTTTTAATTC |
| 480 | TATATTTTTTTACCCCT |
| 481 | TCAAATATACATCCTTG |
| 482 | GTCAAATATACATCCT |
| 483 | GGTCAAATATACATCC |
| 484 | AGGTCAAATATACATC |
| 485 | ACCACATTTATCCAATATA |
| 486 | ATAAAAACCACATTTATCCA |
| 487 | ATCACAACCACAAAATCA |
| 488 | ATAAATATTCTTACCTACA |
| 489 | AAGTATAATTTCCTTCTA |
| 490 | AATTTATAGATTAATAAAT |
| 491 | TTTCCACATATTTCCTAC |
| 492 | TGTCTATTTCCACATATT |
| 493 | TCTTTCAACCTTTTATTTA |
| 494 | ATATAAATCACCTGAAAT |
| 495 | ATTAATTCCATCTTCCTT |
| 496 | TCATTAATTCCATCTTCC |
| 497 | TGTCATTAATTCCATCTT |
| 498 | AACATGTCATTAATTCC |
| 499 | CCTTCAACTGAACTTC |
| 500 | AGCCATATCTTTTTATT |
| 501 | TAAGCACCTCAAAATATA |
| 502 | TTATTCATACTAAACACATA |
| 503 | AAAGATCTCATATTCCT |
| 504 | TCTCATTCTTTAACCATAA |
| 505 | TCCCTACTTAAATTATCAA |
| 506 | GCAATGTAAAAACATTAA |
| 507 | CCCATATTTTTTATTTTACA |
| 508 | CCCTTATCTACAAAAATTTA |
| 509 | CTGCTTTATTTACATAT |
| 510 | ACTGCTTTATTTACATA |
| 511 | TCTCAAGTATAACTACA |
| 512 | ACTGCTGAGCAGGATCA |
| 512 | ACTGCTGAGCAGGATCA |
| 512 | ACTGCTGAGCAGGATCA |
| 513 | GCTGAGCAGGATCATGA |
| 513 | GCTGAGCAGGATCATGA |
| 513 | GCTGAGCAGGATCATGA |
| 513 | GCTGAGCAGGATCATGA |
| 514 | AAAATCCAGCCAGTTCCA |
| 514 | AAAATCCAGCCAGTTCCA |
| 514 | AAAATCCAGCCAGTTCCA |
| 514 | AAAATCCAGCCAGTTCCA |
| 515 | ACTGCAATGTACATGTT |
| 515 | ACTGCAATGTACATGTT |
| 515 | ACTGCAATGTACATGTT |
| 515 | ACTGCAATGTACATGTT |
| 515 | ACTGCAATGTACATGTT |
| 516 | TCTATTTGCTTAGCTG |
| 516 | TCTATTTGCTTAGCTG |
| 516 | TCTATTTGCTTAGCTG |

| SEQID | Contiguous Nucleotide Sequence |
|---|---|
| 516 | TCTATTTGCTTAGCTG |
| 516 | TCTATTTGCTTAGCTG |
| 516 | TCTATTTGCTTAGCTG |
| 516 | TCTATTTGCTTAGCTG |
| 517 | CTATTTGCTTAGCTGTT |
| 517 | CTATTTGCTTAGCTGTT |
| 517 | CTATTTGCTTAGCTGTT |
| 517 | CTATTTGCTTAGCTGTT |
| 517 | CTATTTGCTTAGCTGTT |
| 517 | CTATTTGCTTAGCTGTT |
| 517 | CTATTTGCTTAGCTGTT |
| 518 | CTGAGCAGGATCATGA |
| 518 | CTGAGCAGGATCATGA |
| 518 | CTGAGCAGGATCATGA |
| 518 | CTGAGCAGGATCATGA |
| 518 | CTGAGCAGGATCATGA |
| 518 | CTGAGCAGGATCATGA |
| 519 | AAAATCCAGCCAGTTCC |
| 519 | AAAATCCAGCCAGTTCC |
| 519 | AAAATCCAGCCAGTTCC |
| 519 | AAAATCCAGCCAGTTCC |
| 519 | AAAATCCAGCCAGTTCC |
| 519 | AAAATCCAGCCAGTTCC |
| 520 | TCTATTTGCTTAGCTGT |
| 520 | TCTATTTGCTTAGCTGT |
| 520 | TCTATTTGCTTAGCTGT |
| 520 | TCTATTTGCTTAGCTGT |
| 520 | TCTATTTGCTTAGCTGT |
| 521 | TCTATTTGCTTAGCTGTT |
| 521 | TCTATTTGCTTAGCTGTT |
| 521 | TCTATTTGCTTAGCTGTT |
| 521 | TCTATTTGCTTAGCTGTT |
| 521 | TCTATTTGCTTAGCTGTT |
| 522 | TGCTGAGCAGGATCAT |
| 522 | TGCTGAGCAGGATCAT |
| 522 | TGCTGAGCAGGATCAT |
| 522 | TGCTGAGCAGGATCAT |
| 523 | ACTGCAATGTACATGT |
| 523 | ACTGCAATGTACATGT |
| 523 | ACTGCAATGTACATGT |
| 523 | ACTGCAATGTACATGT |
| 523 | ACTGCAATGTACATGT |
| 524 | ATTAGGTTCTCTAAT |
| 525 | ACTGCAATGTACATG |
| 526 | GCAATGTACATGTTCAC |
| 527 | CAATGTACATGTTCAC |
| 528 | GTAGATGAACATGACCAG |
| 529 | GTAGATGAACATGACCAGGA |
| 530 | GTAGATGAACATGACCA |
| 531 | GTAGATGAACATGACCAGG |
| 532 | TAGATGAACATGACC |
| 533 | TAGATGAACATGACCA |
| 534 | TAGATGAACATGACCAGG |
| 535 | TAGATGAACATGACCAGGA |
| 536 | TAGATGAACATGACCAGGAA |
| 537 | AGATGAACATGACCAGGA |
| 538 | AGATGAACATGACCAGG |
| 539 | AGATGAACATGACCAGGAA |
| 540 | GATGAACATGACCAGG |
| 541 | GATGAACATGACCAGGAA |
| 542 | GATGAACATGACCAGGA |
| 543 | ATGAACATGACCAGGA |
| 544 | TGAACATGACCAGGAA |
| 545 | GTGAAGTAGTAGTG |
| 546 | ACTTATCTTCTTTTTCTGTT |
| 547 | ACTTATCTTCTTTTTCTGT |
| 548 | CTTATCTTCTTTTTCTGT |
| 549 | CTTATCTTCTTTTTCTGTTG |
| 550 | CTTATCTTCTTTTTCTGTT |
| 551 | TTATCTTCTTTTTCTGTT |
| 552 | TTATCTTCTTTTTCTGT |
| 553 | TTATCTTCTTTTTCTGTTG |
| 554 | TATCTTCTTTTTCTGTTG |
| 555 | ATCTTCTTTTTCTGTTG |
| 556 | TCCCATGATGCTGAA |

| SEQID | Contiguous Nucleotide Sequence |
|---|---|
| 557 | ACTGCTGAGCAGGATCAT |
| 558 | CTGCTGAGCAGGATCAT |
| 559 | TGCTGAGCAGGATCATG |
| 560 | TGAGCAGGATCATGA |
| 561 | TCTCTATCCACTCTCCA |
| 562 | CTCTATCCACTCTCCA |
| 563 | CTCTATCCACTCTCCAC |
| 564 | CTCTATCCACTCTCCACA |
| 565 | GGAAGGAGTGGAAGAAGTCG |
| 566 | GAAGGAGTGGAAGAAGTCGT |
| 567 | GAAGGAGTGGAAGAAGTCG |
| 568 | AAGGAGTGGAAGAAGTCG |
| 569 | AAGGAGTGGAAGAAGTCGT |
| 570 | AGGAGTGGAAGAAGTCG |
| 571 | AGGAGTGGAAGAAGTCGT |
| 572 | GGAGTGGAAGAAGTCG |
| 573 | GGAGTGGAAGAAGTCGT |
| 574 | GAGTGGAAGAAGTCGTTC |
| 575 | GAGTGGAAGAAGTCGTT |
| 576 | GAGTGGAAGAAGTCGTTCAT |
| 577 | GAGTGGAAGAAGTCG |
| 578 | GAGTGGAAGAAGTCGTTCA |
| 579 | GAGTGGAAGAAGTCGT |
| 580 | AGTGGAAGAAGTCGTTCA |
| 581 | AGTGGAAGAAGTCGTTCAT |
| 582 | AGTGGAAGAAGTCGTTCATG |
| 583 | AGTGGAAGAAGTCGT |
| 584 | AGTGGAAGAAGTCGTT |
| 585 | AGTGGAAGAAGTCGTTC |
| 586 | GTGGAAGAAGTCGTTC |
| 587 | GTGGAAGAAGTCGT |
| 588 | GTGGAAGAAGTCGTTCAT |
| 589 | GTGGAAGAAGTCGTTCATG |
| 590 | GTGGAAGAAGTCGTTCA |
| 591 | GTGGAAGAAGTCGTTCATGT |
| 592 | GTGGAAGAAGTCGTT |
| 593 | TGGAAGAAGTCGTTCATGTG |
| 594 | TGGAAGAAGTCGTTCA |
| 595 | TGGAAGAAGTCGTTCATG |
| 596 | TGGAAGAAGTCGTTC |
| 597 | TGGAAGAAGTCGTTCAT |
| 598 | TGGAAGAAGTCGTTCATGT |
| 599 | GGAAGAAGTCGTTCA |
| 600 | GGAAGAAGTCGTTCAT |
| 601 | GGAAGAAGTCGTTCATGT |
| 602 | GGAAGAAGTCGTTCATGTGC |
| 603 | GGAAGAAGTCGTTCATG |
| 604 | GGAAGAAGTCGTTCATGTG |
| 605 | GAAGAAGTCGTTCATGTG |
| 606 | GAAGAAGTCGTTCATGTGC |
| 607 | GAAGAAGTCGTTCATGTGCC |
| 608 | GAAGAAGTCGTTCAT |
| 609 | GAAGAAGTCGTTCATG |
| 610 | GAAGAAGTCGTTCATGT |
| 611 | AAGAAGTCGTTCATGT |
| 612 | AAGAAGTCGTTCATGTGC |
| 613 | AAGAAGTCGTTCATGTGCCA |
| 614 | AAGAAGTCGTTCATG |
| 615 | AAGAAGTCGTTCAT |
| 616 | AAGAAGTCGTTCATGTGCC |
| 617 | AAGAAGTCGTTCATGTG |
| 618 | AGAAGTCGTTCATGTGCC |
| 619 | AGAAGTCGTTCATGTG |
| 620 | AGAAGTCGTTCATGT |
| 621 | AGAAGTCGTTCATGTGC |
| 622 | AGAAGTCGTTCATG |
| 623 | AGAAGTCGTTCATGTGCCA |
| 624 | GAAGTCGTTCATGTGCC |
| 625 | GAAGTCGTTCATGTGCCA |
| 626 | GAAGTCGTTCATGTGC |
| 627 | AAGTCGTTCATGTGCC |
| 628 | AAGTCGTTCATGTGCCA |
| 629 | AGTCGTTCATGTGCC |
| 630 | AGTCGTTCATGTGCCA |
| 631 | GTCGTTCATGTGCC |
| 632 | TCGTTCATGTGCCA |

| SEQID | Contiguous Nucleotide Sequence |
|---|---|
| 633 | GGCCAGGATTTTGCCA |
| 634 | GGCCAGGATTTTGCC |
| 635 | TCAAAGCTCGTGTAG |
| 636 | CAAAGCTCGTGTAG |
| 637 | AAAGTTCGAAGAGCTG |
| 638 | TATTTGCTTAGCTGTT |
| 639 | GTAGATGAACATGACC |
| 640 | TAGATGAACATGACCAG |
| 641 | ATGAACATGACCAGGAA |
| 642 | TTCACTAAATTTCACTAATC |
| 643 | AATGTACTTATACCCA |
| 644 | CTTACGCAAAAACAAT |
| 645 | ACTTACGCAAAAACAAT |
| 646 | TCACACCAATTACTTCTT |
| 647 | CTTCACACCAATTACTTCTT |
| 648 | TTACTTTATTCATCTCATA |
| 649 | TACTTTATTCATCTCATA |
| 650 | TTGAACCTTCATTATTTC |

The invention provides antisense oligonucleotides which comprise a contiguous nucleotide sequence selected from the group consisting of SEQ ID NO 50-641.

The invention provides antisense oligonucleotides which comprise a contiguous nucleotide sequence selected from the group consisting of SEQ ID NO 642-650.

The invention provides antisense oligonucleotides which comprise a contiguous nucleotide sequence of at least 12 contiguous nucleotides which are identical to a sequence selected from the group consisting of SEQ ID NO 50-641; or SEQ ID NO 642-650.

The invention provides antisense oligonucleotides which comprise a contiguous nucleotide sequence of at least 14 contiguous nucleotides which are identical to a sequence selected from the group consisting of SEQ ID NO 50-641; or SEQ ID NO 642-650.

In some embodiments, with reference to SEQ ID NO 50-641, or SEQ ID Nos 642-650, T may represent either a T or a U nucleobase, and a C may represent a C or a 5-methylC nucleobase.

In some embodiments, with reference to SEQ ID NO 50-641, or SEQ ID Nos 642-650, T is a T nucleobase, A is an A nucleobase, G is a G nucleobase and a C may represent a C or a 5-methylC nucleobase.

In some embodiments the oligonucleotide sequence or contiguous nucleotide sequence of the invention is 100% complementary to a corresponding target nucleic acid region (target sequence) present in SEQ ID NO: 1. In some embodiments the oligonucleotide sequence or contiguous nucleotide sequence is 100% complementary to a corresponding target nucleic acid region present in SEQ ID NO: 1 and SEQ ID NO: 2. In some embodiments the oligonucleotide sequence contiguous nucleotide sequence is 100% complementary to a corresponding target nucleic acid region present SEQ ID NO: 1, 2 and 3.

In some embodiments, the oligonucleotide comprises a contiguous nucleotide sequence of 10 to 30 nucleotides in length with at least 90% complementary, such as 100% complementarity, to a corresponding target sequence selected from any region in Target Sequence List 1.

In some embodiments, the oligonucleotide comprises a contiguous nucleotide sequence of 10 to 30 nucleotides in length with at least 90% complementary, such as 100% complementarity, to a corresponding target sequence selected from any region in Target Sequence List 2.

In some embodiments, the oligonucleotide comprises a contiguous nucleotide sequence of 10 to 30 nucleotides in length with at least 90% complementary, such as 100% complementarity, to a corresponding target sequence selected from any region in Target Sequence List 3.

In some embodiments, the oligonucleotide comprises a contiguous nucleotide sequence of 10 to 30 nucleotides in length with at least 90% complementary, such as 100% complementarity, to a corresponding target sequence selected from any region in Target Sequence List 4.

In some embodiments, the oligonucleotide comprises a contiguous nucleotide sequence of 10 to 30 nucleotides in length with at least 90% complementary, such as 100% complementarity, to a corresponding target sequence selected from SEQ ID NO 17-49.

In one embodiment, the oligonucleotide comprises or consists of a contiguous nucleotide sequence of 12 to 22 nucleotides in length with at least 90% complementary, such as 100% complementarity, to the target sequence of SEQ ID NO 1, selected from the group consisting of 99525-99542; 70094-70110; 133396-133411; 20666-20682; 103244-103261; 20666-20683; 103244-103262; 147238-147253; 171787-171803; 171787-171803; 147238-147253; 171788-171803; 103244-103260; 103244-103262; 130009-130025; 103244-103261; 98600-98616; 103244-103262; 171788-171803; 103244-103261; 70094-70110; 70094-70110; 70094-70110; 70094-70110; 70094-70110; 70094-70110; 70094-70110; 20666-20683; 97712-97728; 75261-75277; 75260-75276; 97713-97730; 75261-75277; 97712-97729; 20666-20683; 97712-97729; 20666-20683; 4426-4443; 75260-75276; 97715-97731; 20666-20683; 97712-97728; 4427-4443; 20666-20683; 97712-97729; 89475-89493; 99308-99324; 13076-13094; 87509-87527; 103272-103290; 82676-82692; 99526-99543; 82675-82691; 87510-87528; 97704-97720; 82675-82691; 89477-89495; and 13076-13094. Such oligonucleotides may be a gapmer, such as an LNA gapmer.

In some embodiments, the oligonucleotide of the invention does not comprise a sequence selected from the group consisting of 301, 311, 312, 323, 342, 343, and 394.

In some embodiments, the oligonucleotide of the invention does not comprise a sequence of 10 or more contiguous nucleotides which are identical to a sequence selected from the group consisting of 301, 311, 312, 323, 342, 343, and 394.

In some embodiments, the oligonucleotide of the invention does not comprise a sequence of 12 or more contiguous nucleotides which are identical to a sequence selected from the group consisting of 301, 311, 312, 323, 342, 343, and 394.

Mismatches

Advantageously, the contiguous nucleotide sequence of the oligonucleotide of the invention is full complementary to the target nucleic acid sequence, such as SEQ ID NO 1, such as a targets sequence selected from those disclosed in Target Sequence lists 1, 2, 3 & 4, or SEQ ID NO 17-49.

In some embodiments however, the oligonucleotide of the invention comprises a mismatch between the oligonucleotide and the target nucleic acid. Despite the mismatch, hybridization to the target nucleic acid may still be sufficient to show a desired modulation of SCN9A expression. Reduced binding affinity resulting from a mismatch may advantageously be compensated by increased number of nucleotides in the oligonucleotide and/or an increased number of modified nucleosides capable of increasing the binding affinity to the target, such as 2' sugar modified nucleosides, including LNA, present within the oligonucleotide sequence.

An aspect described in the present application relates to an antisense oligonucleotide of 10 to 30 nucleotides in length which comprises a contiguous nucleotide sequence of 10 to 30 nucleotides in length with at least 90% complementarity, such as 100% complementarity, to SEQ ID NO: 1. It is generally understood that the contiguous nucleotide sequence is the same length or in some embodiments may be shorter than the antisense oligonucleotide (the sequence of the oligonucleotide may comprise or consist of the contiguous nucleotide sequence).

Oligonucleotide Length

In some embodiments, the oligonucleotide of the invention comprises or consists of 10 to 30 nucleotides in length, such as from 11 to 28, such as from 10 to 22, such as from 12 to 22, such as from 14 to 20, such as from 15 to 20 such as from 16 to 18 such as from 17 to 20 or 18 to 20 contiguous nucleotides in length. In a preferred embodiment, the oligonucleotide comprises or consists of 17 to 20 nucleotides in length.

In some embodiments, the oligonucleotide or contiguous nucleotide sequence thereof comprises or consists of 24 or less nucleotides, such as 22 or less nucleotides, such as 20 or less nucleotides, such as 17, 18, 19 or 20 nucleotides. It is to be understood that any range given herein includes the range endpoints. Accordingly, if an oligonucleotide is said to include from 10 to 30 nucleotides, both 10 and 30 nucleotides are included.

In some embodiments, the contiguous nucleotide sequence comprises or consists of 10, 11, 12, 13, 14, 15, 16, 17, 18, 19, 20, 21, 22, 23, 24, 25, 26, 27, 28, 29 or 30 contiguous nucleotides in length.

Modified Oligonucleotides

The oligonucleotide of the invention is a modified oligonucleotide—i.e. it comprises modified nucleosides or modified nucleotides, other than unmodified RNA or unmodified DNA.

It is understood that the contiguous nucleobase sequences (motif sequence) can be modified to for example increase nuclease resistance and/or binding affinity to the target nucleic acid.

The pattern in which the modified nucleosides (such as high affinity modified nucleosides) are incorporated into the oligonucleotide sequence is generally termed oligonucleotide design.

The oligonucleotides of the invention are designed with modified nucleosides and DNA nucleosides. Advantageously, high affinity modified nucleosides are used.

In an embodiment, the oligonucleotide comprises at least 1 modified nucleoside, such as at least 2, at least 3, at least 4, at least 5, at least 6, at least 7, at least 8, at least 9, at least 10, at least 11, at least 12, at least 13, at least 14, at least 15 or at least 16 modified nucleosides. In an embodiment the oligonucleotide comprises from 1 to 10 modified nucleosides, such as from 2 to 9 modified nucleosides, such as from 3 to 8 modified nucleosides, such as from 4 to 7 modified nucleosides, such as 6 or 7 modified nucleosides. Suitable modifications are described in the "Definitions" section under "modified nucleoside", "high affinity modified nucleosides", "sugar modifications", "2' sugar modifications" and Locked nucleic acids (LNA)".

In an embodiment, the oligonucleotide comprises one or more sugar modified nucleosides, such as 2' sugar modified nucleosides. Preferably the oligonucleotide of the invention comprise one or more 2' sugar modified nucleoside independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA and LNA nucleosides. It is advantageous if one or more of the modified nucleoside(s) is a locked nucleic acid (LNA).

In a further embodiment the oligonucleotide or contiguous nucleotide sequence comprises at least one modified internucleoside linkage, such as at least one phosphorothioate internucleoside linkages. Suitable internucleoside modifications are described in the "Definitions" section under "Modified internucleoside linkage". It is advantageous if at least 75%, such as all, the internucleoside linkages within the contiguous nucleotide sequence are phosphorothioate internucleoside linkages. In some embodiments all the internucleotide linkages in the contiguous sequence of the oligonucleotide are phosphorothioate linkages.

In some embodiments, the oligonucleotide of the invention comprises at least one LNA nucleoside, such as 1, 2, 3, 4, 5, 6, 7, or 8 LNA nucleosides, such as from 2 to 6 LNA nucleosides, such as from 3 to 7 LNA nucleosides, 4 to 8 LNA nucleosides or 3, 4, 5, 6, 7 or 8 LNA nucleosides. In some embodiments, at least 75% of the modified nucleosides in the oligonucleotide are LNA nucleosides, such as 80%, such as 85%, such as 90% of the modified nucleosides are LNA nucleosides. In a still further embodiment all the modified nucleosides in the oligonucleotide are LNA nucleosides. In a further embodiment, the oligonucleotide may comprise both beta-D-oxy-LNA, and one or more of the following LNA nucleosides: thio-LNA, amino-LNA, oxy-LNA, ScET and/or ENA in either the beta-D or alpha-L configurations or combinations thereof. In a further embodiment, all LNA cytosine units are 5-methyl-cytosine. It is advantageous for the nuclease stability of the oligonucleotide or contiguous nucleotide sequence to have at least 1 LNA nucleoside at the 5' end and at least 2 LNA nucleosides at the 3' end of the nucleotide sequence.

In an embodiment of the invention the oligonucleotide of the invention is capable of recruiting RNase H, such as human RNaseH1.

In the current invention an advantageous structural design is a gapmer design as described in the "Definitions" section under for example "Gapmer", "LNA Gapmer", "MOE gapmer" and "Mixed Wing Gapmer" "Alternating Flank Gapmer". The gapmer design includes gapmers with uniform flanks, mixed wing flanks, alternating flanks, and gapbreaker designs. In the present invention it is advantageous if the oligonucleotide of the invention is a gapmer with an F-G-F' design where region F and F' independently comprise 1-8 nucleosides, of which 1-5 are 2' sugar modified and defines the 5' and 3' end of the F and F' region, and G is a region between 6 and 16 nucleosides which are capable of recruiting RNaseH. In one embodiment the G region consists of 6-16 contiguous DNA nucleosides. In a further embodiment region F and F' each comprise at least one LNA nucleoside.

In all instances the F-G-F' design may further include region D' and/or D" as described in the "Definitions" section under "Region D' or D" in an oligonucleotide". In some embodiments the oligonucleotide of the invention has 1, 2 or 3 phosphodiester linked nucleoside units, such as DNA units, at the 5' or 3' end of the gapmer region.

Oligonucleotides

In some embodiments of the invention, the oligonucleotide is selected from the group of oligonucleotide compounds with CMP-ID-NO: 50_1; 51_1; 52_1; 53_1; 54_1; 55_1; 56_1; 57_1; 58_1; 59_1; 60_1; 61_1; 62_1; 63_1; 64_1; 65_1; 66_1; 67_1; 68_1; 69_1; 70_1; 71_1; 72_1; 73_1; 74_1; 75_1; 76_1; 77_1; 78_1; 79_1; 80_1; 81_1; 82_1; 83_1; 84_1; 85_1; 86_1; 87_1; 88_1; 89_1; 90_1; 91_1; 92_1; 93_1; 94_1; 95_1; 96_1; 97_1; 98_1; 99_1; 100_1; 101_1; 102_1; 103_1; 104_1; 105_1; 106_1; 107_1; 108_1; 109_1 110_1; 111_1; 112_1; 113_1; 114_1; 115_1; 116_1; 117_1; 118_1; 119_1; 120_1; 121_1; 122_1; 123_1; 124_1; 125_1; 126_1; 127_1; 128_1; 129_1; 130_1; 131_1; 132_1; 133_1; 134_1; 135_1; 136_1; 137_1; 138_1; 139_1; 140_1; 141_1; 142_1; 143_1; 144_1; 145_1; 146_1; 147_1; 148_1; 149_1; 150_1; 151_1; 152_1; 153_1; 154_1; 155_1; 156_1; 157_1; 158_1; 159_1; 160_1; 161_1; 162_1; 163_1; 164_1; 165_1; 166_1; 167_1; 168_1; 169_1; 170_1; 171_1; 172_1; 173_1; 174_1; 175_1; 176_1; 177_1; 178_1; 179_1; 180_1; 181_1; 182_1; 183_1; 184_1; 185_1; 186_1; 187_1; 188_1; 189_1; 190_1; 191_1; 192_1; 193_1; 194_1; 195_1; 196_1; 197_1; 198_1; 199_1; 200_1; 201_1; 202_1; 203_1; 204_1; 205_1; 206_1; 207_1; 208_1; 209_1; 210_1; 211_1; 212_1; 213_1; 214_1; 215_1; 216_1; 217_1; 218_1; 219_1; 220_1; 221_1; 222_1; 223_1; 224_1; 225_1; 226_1; 227_1; 228_1; 229_1; 230_1; 231_1; 232_1; 233_1; 234_1; 235_1; 236_1; 237_1; 238_1; 239_1; 240_1; 241_1; 242_1; 243_1; 244_1; 245_1; 246_1; 247_1; 248_1; 249_1; 250_1; 251_1; 252_1; 253_1; 254_1; 255_1; 256_1; 257_1; 258_1; 259_1; 260_1; 261_1; 262_1; 263_1; 264_1; 265_1; 266_1; 267_1; 268_1; 269_1; 270_1; 271_1; 272_1; 273_1; 274_1; 275_1; 276_1; 277_1; 278_1; 279_1; 280_1; 281_1; 282_1; 283_1; 284_1; 285_1; 286_1; 287_1; 288_1; 289_1; 290_1; 291_1; 292_1; 293_1; 294_1; 295_1; 296_1; 297_1; 298_1; 299_1; 300_1; 301_1; 302_1; 303_1; 304_1; 305_1; 306_1; 307_1; 308_1; 309_1; 310_1; 311_1; 312_1; 313_1; 314_1; 315_1; 316_1; 317_1; 318_1; 319_1; 320_1; 321_1; 322_1; 323_1; 324_1; 325_1; 326_1; 327_1; 328_1; 329_1; 330_1; 331_1; 332_1; 333_1; 334_1; 335_1; 336_1; 337_1; 338_1; 339_1; 340_1; 341_1; 342_1; 343_1; 344_1; 345_1; 346_1; 347_1; 348_1; 349_1; 350_1; 351_1; 352_1; 353_1; 354_1; 355_1; 356_1; 357_1; 358_1; 359_1; 360_1; 361_1; 362_1; 363_1; 364_1; 365_1; 366_1; 367_1; 368_1; 369_1; 370_1; 371_1; 372_1; 373_1; 374_1; 375_1; 376_1; 377_1; 378_1; 379_1; 380_1; 381_1; 382_1; 383_1; 384_1; 385_1; 386_1; 387_1; 388_1; 389_1; 390_1; 391_1; 392_1; 393_1; 394_1; 395_1; 396_1; 397_1; 398_1; 399_1; 400_1; 401_1; 402_1; 403_1; 404_1; 405_1; 406_1; 407_1; 408_1; 409_1; 410_1; 411_1; 412_1; 413_1; 414_1; 415_1; 416_1; 417_1; 418_1; 419_1; 420_1; 421_1; 422_1; 423_1; 424_1; 425_1; 426_1; 427_1; 428_1; 429_1; 430_1; 431_1; 432_1; 433_1; 434_1; 435_1; 436_1; 437_1; 438_1; 439_1; 440_1; 441_1; 442_1; 443_1; 444_1; 445_1; 446_1; 447_1; 448_1; 449_1; 450_1; 451_1; 452_1; 453_1; 454_1; 455_1; 456_1; 457_1; 458_1; 459_1; 460_1; 461_1; 462_1; 463_1; 464_1; 465_1; 466_1; 467_1; 468_1; 469_1; 470_1; 471_1; 472_1; 473_1; 474_1; 475_1; 476_1; 477_1; 478_1; 479_1; 480_1; 481_1; 482_1; 483_1; 484_1; 485_1; 486_1; 487_1; 488_1; 489_1; 490_1; 491_1; 492_1; 493_1; 494_1; 495_1; 496_1; 4971; 498_1; 499_1; 500_1; 501_1; 502_1; 503_1; 504_1; 505_1; 506_1; 507_1; 508_1; 509_1; 510_1; 511_1; 512_1; 512_2; 512_3; 513_1; 513_2; 513_3; 513_4; 514_1; 514_2; 514_3; 514_4; 515_1; 515_2; 515_3; 515_4; 515_5; 515_6; 516_1; 516_2; 516_3; 516_4; 516_5; 516_6; 516_7; 517_1; 517_2; 517_3; 517_4; 517_5; 517_6; 517_7; 517_8; 518_1; 518_2; 518_3; 518_4; 518_5; 518_6; 519_1; 519_2; 519_3; 519_4; 519_5; 519_6; 520_1; 520_2; 520_3; 520_4; 520_5; 521_1; 521_2; 521_3; 521_4; 521_5; 522_1; 522_2; 522_3; 522_4; 523_1; 523_2; 523_3; 523_4; 523_5; 524_1; 525_1; 526_1; 527_1; 528_1; 529_1; 530_1; 531_1; 532_1; 533_1; 534_1; 535_1; 536_1; 537_1; 538_1; 539_1; 540_1; 541_1; 542_1; 543_1; 544_1; 545_1; 546_1; 547_1; 548_1; 549_1; 550_1; 551_1; 552_1; 553_1; 554_1; 555_1; 556_1; 557_1; 558_1; 559_1; 560_1; 561_1; 562_1; 563_1; 564_1; 565_1; 566_1; 567_1; 568_1; 569_1; 570_1; 571_1; 572_1; 573_1; 574_1; 575_1; 576_1; 577_1; 578_1; 579_1; 580_1; 581_1; 582_1; 583_1; 584_1; 585_1; 586_1; 587_1; 588_1; 589_1; 590_1; 591_1; 592_1; 593_1; 594_1; 595_1; 596_1; 597_1; 598_1; 599_1; 600_1; 601_1; 602_1; 603_1; 604_1; 605_1; 606_1; 607_1; 608_1; 609_1; 610_1; 611_1; 612_1; 613_1; 614_1; 615_1; 616_1; 617_1; 618_1; 619_1; 620_1; 621_1; 622_1; 623_1; 624_1; 625_1; 626_1; 6271; 628_1; 629_1; 630_1; 631_1; 632_1; 633_1; 634_1; 635_1; 636_1; 637_1; 638_1; 639_1; 640_1; and 641_1.

In some embodiments of the invention, the oligonucleotide is selected from the group of oligonucleotide compounds with CMP-ID-NO: 642_1, 643_1, 644_1, 645_1, 646_1, 647_1, 6481, 649_1 and 650_1.

In some embodiments, the invention provides a compound selected from the group consisting of CMP-ID-NO: 50_1-641_1.

In some embodiments, the invention provides a compound selected from the group consisting of CMP-ID-NO: 642_1, 643_1, 644_1, 645_1, 646_1, 647_1, 648_1, 649_1 and 650_1.

These compounds are listed in the compound table at the end of the example section and were tested for their ability to inhibit SCN9A in vitro via gymnotic delivery.

The following compounds gave at least 40% inhibition of SCN9A expression:

51_1, 59_1, 127_1, 161_1, 67_1, 106_1, 72_1, 124_1, 163_1, 99_1, 125_1, 110_1, 65_1, 94_1, 64_1, 57_1, 13_6_1, 15_8_1, 159_1, 356_1, 197_1, 132_1, 83_1, 76_1, 130_1, 135_1, 77_1, 186_1, 105_1, 445_1, 325_1, 265_1, 200_1, 288_1, 346_1, 86_1, 281_1, 339_1, 256_1, 289_1, 414_1, 286_1, 241_1, 82_1, 475_1, 91_1, 50_1, 971, 322_1, 148_1, 443_1, 251_1, 451_1, 179_1, 466_1, 357_1, 109_1, 472_1, 471_1, 376_1, 413_1, 270_1, 379_1, 416_1, 311_1, 411_1, 368_1, 333_1, 347_1, 152_1, 89_1, 380_1, 390_1, 429_1, 63_1, 90_1, 415_1, 199_1, 503_1, 476_1, 92_1, 268_1, 371_1, 302_1, 485_1, 205_1, 274_1, 122_1, 419_1, 470_1, 498_1, 156_1, 478_1, 393_1, 312_1, 287_1, 96_1, 226_1, 71_1, 137_1, 365_1, 58_1, 370_1, 280_1, 385_1, 442_1, 134_1, 463_1, 140_1, 440_1, 230_1, 310_1, 479_1, 363_1, 340_1, 495_1, 467_1, 444_1, 418_1, 338_1, 335_1, 496_1, 196_1, 317_1, 341_1, 406_1, 330_1, 173_1, 377_1, 474_1, 482_1, 282_1, 266_1, 73_1, 257_1, 342_1, 190_1, 492_1, 87_1, 188_1, 456_1, 372_1, 417_1, 404_1, 239_1, 206_1, 433_1, 486_1, 175_1, 461_1, 56_1, 408_1, 334_1, 504_1, 453_1, 222_1, 410_1, 104_1, 460_1, 439_1, 255_1, 489_1, 203_1, 398_1, 171_1, 407_1, 172_1, 412_1, 321_1, 305_1, 328_1, 120_1, 434_1, 449_1, 350_1, 487_1, 146_1, 420_1, 426_1, 352_1, 150_1, 316_1, 353_1, 469_1, 306_1, 3841, 155_1, 450_1, 279_1, 267_1, 337_1, 184_1, 459_1, 360_1, 75_1, 468_1, 180_1, 245_1, 387_1, 345_1, 98_1,

435_1, 295_1, 369_1, 218_1, 182_1, 448_1, 300_1, 481_1, 427_1, 207_1, 367_1, 240_1, 231_1, 364_1, 355_1, 431_1, 497_1, 397_1, 465_1, 271_1, 502_1, 151_1, 178_1, 499_1, 421_1, 131_1, 309_1, 491_1, 261_1, 121_1, 128_1, 84_1, 304_1, 264_1, 493_1, 185_1, 237_1, 139_1, 441_1, 169_1, 160_1, 102_1, 296_1, 164_1, 362_1, 500_1, and 100_1.

The following compounds gave at least 50% inhibition of SCN9A expression:

51_1, 59_1, 127_1, 161_1, 67_1, 106_1, 72_1, 124_1, 163_1, 99_1, 125_1, 110_1, 65_1, 94_1, 64_1, 57_1, 136_1, 158_1, 159_1, 356_1, 197_1, 132_1, 83_1, 76_1, 130_1, 135_1, 77_1, 186_1, 105_1, 445_1, 325_1, 265_1, 200_1, 288_1, 346_1, 86_1, 281_1, 339_1, 256_1, 289_1, 414_1, 286_1, 241_1, 82_1, 475_1, 91_1, 50_1, 97_1, 322_1, 148_1, 443_1, 251_1, 451_1, 179_1, 466_1, 357_1, 109_1, 472_1, 471_1, 376_1, 413_1, 270_1, 379_1, 416_1, 311_1, 411_1, 368_1, 333_1, 347_1, 152_1, 89_1, 380_1, 390_1, 429_1, 63_1, 90_1, 415_1, 199_1, 503_1, 476_1, 92_1, 268_1, 371_1, 302_1, 485_1, 205_1, 274_1, 122_1, 419_1, 470_1, 498_1, 156_1, 478_1, 393_1, 312_1, 287_1, 96_1, 226_1, 71_1, 137_1, 365_1, 58_1, 370_1, 280_1, 385_1, 442_1, 134_1, 463_1, 140_1, 440_1, 230_1, 310_1, 479_1, 363_1, 340_1, 495_1, 467_1, 444_1, 418_1, 338_1, 335_1, 496_1, 196_1, 317_1, 341_1, 406_1, 330_1, 173_1, 377_1, 474_1, 482_1, 282_1, 266_1, 73_1, 257_1, 342_1, 190_1, 492_1, 87_1, 188_1, 456_1, 372_1, 417_1, 404_1, 239_1, 206_1, 433_1, 486_1, 175_1, 461_1, 56_1, 408_1, 334_1, 504_1, 453_1, 222_1, 410_1, 104_1, 460_1, 439_1, 255_1, 489_1, 203_1, 398_1, 171_1, 407_1, 172_1, 412_1, 321_1, 305_1, 328_1, 120_1, 434_1, 449_1, 350_1, 487_1, 146_1, 420_1, 426_1, 352_1, 150_1, 316_1, 353_1, 469_1, 306_1, 384_1, 155_1, 450_1, 279_1, 267_1, 337_1, 184_1, 459_1, 360_1, 75_1, 468_1, 180_1, 245_1, 387_1, 345_1, 98_1, 435_1, 295_1, 369_1, 218_1, 182_1, 448_1, 300_1, 481_1, 427_1, 207_1

The following compounds gave at least 60% inhibition of SCN9A expression:

51_1, 59_1, 127_1, 161_1, 67_1, 106_1, 72_1, 124_1, 163_1, 99_1, 125_1, 110_1, 65_1, 94_1, 64_1, 57_1, 136_1, 158_1, 159_1, 356_1, 197_1, 132_1, 83_1, 76_1, 130_1, 135_1, 77_1, 186_1, 105_1, 445_1, 325_1, 265_1, 200_1, 288_1, 346_1, 86_1, 281_1, 339_1, 256_1, 289_1, 414_1, 286_1, 241_1, 82_1, 475_1, 91_1, 50_1, 97_1, 322_1, 148_1, 443_1, 251_1, 451_1, 179_1, 466_1, 357_1, 109_1, 472_1, 471_1, 376_1, 413_1, 270_1, 379_1, 416_1, 311_1, 411_1, 368_1, 333_1, 347_1, 152_1, 89_1, 380_1, 390_1, 429_1, 63_1, 90_1, 415_1, 199_1, 503_1, 476_1, 92_1, 268_1, 371_1, 302_1, 485_1, 205_1, 274_1, 122_1, 419_1, 470_1, 498_1, 156_1, 478_1, 393_1, 312_1, 287_1, 96_1, 226_1, 71_1, 137_1, 365_1, 58_1, 370_1, 280_1, 385_1, 442_1, 134_1, 463_1, 140_1, 440_1, 230_1, 310_1, 479_1, 363_1, 340_1, 495_1, 467_1, 444_1, 418_1, 338_1, 335_1, 496_1, 196_1, 317_1, 341_1, 406_1, 330_1, 173_1, 377_1, 474_1, 482_1, 282_1, 266_1, 73_1, 257_1, 342_1, 190_1, 492_1, 87_1, 188_1, 456_1, 372_1, 417_1, 404_1, 239_1, 206_1, 433_1, 486_1, 175_1, 461_1, 56_1, 408_1, 334_1, 504_1, and 453_1.

The following compounds gave at least 70% inhibition of SCN9A expression:

51_1, 59_1, 127_1, 161_1, 67_1, 106_1, 72_1, 124_1, 163_1, 99_1, 125_1, 110_1, 65_1, 94_1, 64_1, 57_1, 136_1, 158_1, 159_1,3 56_1, 197_1, 132_1, 83_1, 76_1, 130_1, 135_1, 77_1, 186_1, 105_1, 445_1, 325_1, 265_1, 200_1, 288_1, 346_1, 86_1, 281_1, 339_1, 256_1, 289_1, 414_1, 286_1, 241_1, 82_1, 475_1, 91_1, 50_1, 971, 322_1, 148_1, 443_1, 251_1, 451_1, 179_1, 466_1, 357_1, 109_1, 472_1, 471_1, 376_1, 413_1, 270_1, 379_1, 416_1, 311_1, 411_1, 368_1, 333_1, 347_1, 152_1, 89_1, 380_1, 390_1, 429_1, 63_1, 90_1, 415_1, 199_1, 503_1, 476_1, 92_1, 268_1, 371_1, 302_1, 485_1, 205_1, 274_1.

The following compounds gave at least 80% inhibition of SCN9A expression:

51_1, 59_1, 127_1, 161_1, 67_1, 106_1, 72_1, 124_1, 163_1, 99_1, 125_1, 110_1, 65_1, 94_1, 64_1, 57_1, 136_1, 158_1, 159_1, 356_1, 197_1, 132_1, 83_1, 76_1, 130_1, 135_1, 77_1, 186_1, 105_1, 445_1, and 325_1.

The following compounds gave at least 90% inhibition of SCN9A expression:

51_1, 59_1, 127_1, 161_1, 67_1, 106_1, 72_1, 124_1, 163_1, 99_1, 125_1, and 110_1.

In the compounds identified by a compound ID, Capital letters are beta-D-oxy LNA nucleosides, lowercase letters are DNA nucleosides, all LNA C are 5-methyl cytosine, all internucleoside linkages are phosphorothioate internucleoside linkages.

In some embodiments, the oligonucleotide of the invention comprises a contiguous nucleotide sequence comprising at least 10 or at least 12 contiguous nucleotides of a sequence selected from the group consisting of SEQ ID NO 50; 51; 52; 53; 54; 55; 56; 57; 58; 59; 60; 61; 62; 63; 64; 65; 66; 67; 68; 69; 70; 71; 72; 73; 74; 75; 76; 77; 78; 79; 80; 81; 82; 83; 84; 85; 86; 87; 88; 89; 90; 91; 92; 93; 94; 95; 96; 97; 98; 99; 100; 101; 102; 103; 104; 105; 106; 107; 108; 109; 110; 111; 112; 113; 114; 115; 116; 117; 118; 119; 120; 121; 122; 123; 124; 125; 126; 127; 128; 129; 130; 131; 132; 133; 134; 135; 136; 137; 138; 139; 140; 141; 142; 143; 144; 145; 146; 147; 148; 149; 150; 151; 152; 153; 154; 155; 156; 157; 158; 159; 160; 161; 162; 163; 164; 165; 166; 167; 168; 169; 170; 171; 172; 173; 174; 175; 176; 177; 178; 179; 180; 181; 182; 183; 184; 185; 186; 187; 188; 189; 190; 191; 192; 193; 194; 195; 196; 197; 198; 199; 200; 201; 202; 203; 204; 205; 206; 207; 208; 209; 210; 211; 212; 213; 214; 215; 216; 217; 218; 219; 220; 221; 222; 223; 224; 225; 226; 227; 228; 229; 230; 231; 232; 233; 234; 235; 236; 237; 238; 239; 240; 241; 242; 243; 244; 245; 246; 247; 248; 249; 250; 251; 252; 253; 254; 255; 256; 257; 258; 259; 260; 261; 262; 263; 264; 265; 266; 267; 268; 269; 270; 271; 272; 273; 274; 275; 276; 277; 278; 279; 280; 281; 282; 283; 284; 285; 286; 287; 288; 289; 290; 291; 292; 293; 294; 295; 296; 297; 298; 299; 300; 301; 302; 303; 304; 305; 306; 307; 308; 309; 310; 311; 312; 313; 314; 315; 316; 317; 318; 319; 320; 321; 322; 323; 324; 325; 326; 327; 328; 329; 330; 331; 332; 333; 334; 335; 336; 337; 338; 339; 340; 341; 342; 343; 344; 345; 346; 347; 348; 349; 350; 351; 352; 353; 354; 355; 356; 357; 358; 359; 360; 361; 362; 363; 364; 365; 366; 367; 368; 369; 370; 371; 372; 373; 374; 375; 376; 377; 378; 379; 380; 381; 382; 383; 384; 385; 386; 387; 388; 389; 390; 391; 392; 393; 394; 395; 396; 397; 398; 399; 400; 401; 402; 403; 404; 405; 406; 407; 408; 409; 410; 411; 412; 413; 414; 415; 416; 417; 418; 419; 420; 421; 422; 423; 424; 425; 426; 427; 428; 429; 430; 431; 432; 433; 434; 435; 436; 437; 438; 439; 440; 441; 442; 443; 444; 445; 446; 447; 448; 449; 450; 451; 452; 453; 454; 455; 456; 457; 458; 459; 460; 461; 462; 463; 464; 465; 466; 467; 468; 469; 470; 471; 472; 473; 474; 475; 476; 477; 478; 479; 480; 481; 482; 483; 484; 485; 486; 487; 488; 489; 490; 491; 492; 493; 494; 495; 496; 497; 498; 499; 500; 501; 502; 503; 504; 505;

506; 507; 508; 509; 510; 511; 512; 513; 514; 515; 516; 517; 518; 519; 520; 521; 522; 523; 524; 525; 526; 527; 528; 529; 530; 531; 532; 533; 534; 535; 536; 537; 538; 539; 540; 541; 542; 543; 544; 545; 546; 547; 548; 549; 550; 551; 552; 553; 554; 555; 556; 557; 558; 559; 560; 561; 562; 563; 564; 565; 566; 567; 568; 569; 570; 571; 572; 573; 574; 575; 576; 577; 578; 579; 580; 581; 582; 583; 584; 585; 586; 587; 588; 589; 590; 591; 592; 593; 594; 595; 596; 597; 598; 599; 600; 601; 602; 603; 604; 605; 606; 607; 608; 609; 610; 611; 612; 613; 614; 615; 616; 617; 618; 619; 620; 621; 622; 623; 624; 625; 626; 627; 628; 629; 630; 631; 632; 633; 634; 635; 636; 637; 638; 639; 640; and 641.

In some embodiments, the oligonucleotide of the invention comprises a contiguous nucleotide sequence comprising at least 10 or at least 12 contiguous nucleotides of a sequence selected from the group consisting of SEQ ID NO 642, 643, 644, 645, 646, 647, 648, 649 and 650.

In some embodiments, the oligonucleotide of the invention comprises a contiguous nucleotide sequence comprising at least 10 or at least 12 contiguous nucleotides of a sequence selected from the group consisting of SEQ ID NO 51, 59, 127, 161, 67, 106, 72, 124, 163, 99, 125, 110, 65, 94, 64, 57, 136, 158,159, 356, 197, 132, 83, 76, 130, 135, 77, 186, 105, 445, 325, 265, 200, 288, 346, 86, 281, 339, 256, 289, 414, 286, 241, 82, 475, 91, 50, 97, 322, 148, 443, 251, 451, 179, 466, 357, 109, 472, 471, 376, 413, 270, 379, 416, 311, 411, 368, 333, 347, 152, 89, 380, 390, 429, 63, 90, 415, 199, 503, 476, 92, 268, 371, 302, 485, 205, 274, 122, 419, 470, 498, 156, 478, 393, 312, 287, 96, 226, 71, 137, 365, 58, 370, 280, 385, 442, 134, 463, 140, 440, 230, 310, 479, 363, 340, 495, 467, 444, 418, 338, 335, 496, 196, 317, 341, 406, 330, 173, 377, 474, 482, 282, 266, 73, 257, 342, 190, 492, 87, 188, 456, 372, 417, 404, 239, 206, 433, 486, 175, 461, 56, 408, 334, 504, 453, 222, 410, 104, 460, 439, 255, 489, 203, 398, 171, 407, 172, 412, 321, 305, 328,120, 434, 449, 350, 487,146, 420, 426, 352, 150, 316, 353, 469, 306, 384, 155, 450, 279, 267, 337, 184, 459, 360, 75, 468, 180, 245, 387, 345, 98, 435, 295, 369, 218, 182, 448, 300, 481, 427, 207, 367, 240, 231, 364, 355, 431, 497, 397, 465, 271, 502, 151, 178, 499, 421, 131, 309, 491, 261, 121, 128, 84, 304, 264, 493, 185, 237, 139, 441, 169,160, 102, 296, 164, 362, 500, and 100.

In some embodiments, the oligonucleotide of the invention comprises a contiguous nucleotide sequence comprising at least 10 or at least 12 contiguous nucleotides of a sequence selected from the group consisting of SEQ ID NO 51, 59, 127, 161, 67, 106, 72, 124, 163, 99, 125, 110, 65, 94, 64, 57, 136, 158,159, 356, 197, 132, 83, 76, 130, 135, 77, 186, 105, 445, 325, 265, 200, 288, 346, 86, 281, 339, 256, 289, 414, 286, 241, 82, 475, 91, 50, 97, 322, 148, 443, 251, 451, 179, 466, 357, 109, 472, 471, 376, 413, 270, 379, 416, 311, 411, 368, 333, 347, 152, 89, 380, 390, 429, 63, 90, 415, 199, 503, 476, 92, 268, 371, 302, 485, 205, 274, 122, 419, 470, 498, 156, 478, 393, 312, 287, 96, 226, 71, 137, 365, 58, 370, 280, 385, 442, 134, 463, 140, 440, 230, 310, 479, 363, 340, 495, 467, 444, 418, 338, 335, 496, 196, 317, 341, 406, 330, 173, 377, 474, 482, 282, 266, 73, 257, 342, 190, 492, 87, 188, 456, 372, 417, 404, 239, 206, 433, 486, 175, 461, 56, 408, 334, 504, 453, 222, 410, 104, 460, 439, 255, 489, 203, 398, 171, 407, 172, 412, 321, 305, 328,120, 434, 449, 350, 487,146, 420, 426, 352, 150, 316, 353, 469, 306, 384, 155, 450, 279, 267, 337, 184, 459, 360, 75, 468, 180, 245, 387, 345, 98, 435, 295, 369, 218, 182, 448, 300, 481, 427, and 207.

In some embodiments, the oligonucleotide of the invention comprises a contiguous nucleotide sequence comprising at least 10 or at least 12 contiguous nucleotides of a sequence selected from the group consisting of 51, 59, 127, 161, 67, 106, 72, 124, 163, 99, 125, 110, 65, 94, 64, 57, 136, 158, 159, 356, 197, 132, 83, 76, 130, 135, 77, 186, 105, 445, 325, 265, 200, 288, 346, 86, 281, 339, 256, 289, 414, 286, 241, 82, 475, 91, 50, 97, 322, 148, 443, 251, 451, 179, 466, 357, 109, 472, 471, 376, 413, 270, 379, 416, 311, 411, 368, 333, 347,152, 89, 380, 390, 429, 63, 90, 415, 199, 503, 476, 92, 268, 371, 302, 485, 205, 274, 122, 419, 470, 498, 156, 478, 393, 312, 287, 96, 226, 71, 137, 365, 58, 370, 280, 385, 442, 134, 463, 140, 440, 230,310, 479, 363, 340, 495, 467, 444, 418, 338, 335, 496,196, 317, 341, 406, 330,173, 377, 474, 482, 282, 266, 73, 257, 342, 190, 492, 87, 188, 456, 372, 417, 404, 239, 206, 433, 486, 175,461, 56, 408, 334, 504, and 453.

In some embodiments, the oligonucleotide of the invention comprises a contiguous nucleotide sequence comprising at least 10 or at least 12 contiguous nucleotides of a sequence selected from the group consisting of SEQ ID NO 51, 59, 127, 161, 67, 106, 72, 124, 163, 99, 125, 110, 65, 94, 64, 57, 136, 158,159, 356, 197, 132, 83, 76, 130, 135, 77, 186, 105, 445, 325, 265, 200, 288, 346, 86, 281, 339, 256, 289, 414, 286, 241, 82, 475, 91, 50, 97, 322, 148, 443, 251, 451, 179, 466, 357, 109, 472, 471, 376, 413, 270, 379, 416, 311, 411, 368, 333, 347, 152, 89, 380, 390, 429, 63, 90, 415, 199, 503, 476, 92, 268, 371, 302, 485, 205, and 274.

In some embodiments, the oligonucleotide of the invention comprises a contiguous nucleotide sequence comprising at least 10 or at least 12 contiguous nucleotides of a sequence selected from the group consisting of SEQ ID NO 51, 59, 127, 161, 67, 106, 72, 124, 163, 99, 125, 110, 65, 94, 64, 57, 136, 158,159, 356, 197, 132, 83, 76, 130, 135, 77, 186, 105, 445, and 325.

In some embodiments, the oligonucleotide of the invention comprises a contiguous nucleotide sequence comprising at least 10 or at least 12 contiguous nucleotides of a sequence selected from the group consisting of SEQ ID NOs 512-641.

In some embodiments, the oligonucleotide of the invention comprises a contiguous nucleotide sequence comprising at least 13 or at least 14 contiguous nucleotides of a sequence selected from the group consisting of SEQ ID NOs 512-641.

In some embodiments, the oligonucleotide of the invention comprises a contiguous nucleotide sequence selected from the group consisting of SEQ ID NOs 512-641.

In some embodiments, the oligonucleotide of the invention comprises a contiguous nucleotide sequence comprising at least 14 contiguous nucleotides of the selected sequence.

In some embodiments, the oligonucleotide of the invention comprises a contiguous nucleotide sequence comprising at least 15 contiguous nucleotides of the selected sequence.

In some embodiments, the oligonucleotide of the invention comprises a contiguous nucleotide sequence which comprises or consists of the selected sequence.

Method of Manufacture

In a further aspect, the invention provides methods for manufacturing the oligonucleotides of the invention comprising reacting nucleotide units and thereby forming covalently linked contiguous nucleotide units comprised in the oligonucleotide. Preferably, the method uses phophoramidite chemistry (see for example Caruthers et al, 1987, Methods in Enzymology vol. 154, pages 287-313). In a further embodiment the method further comprises reacting the contiguous nucleotide sequence with a conjugating moiety (ligand) to covalently attach the conjugate moiety to the oligonucleotide. In a further aspect a method is provided for manufacturing the composition of the invention, comprising mixing the oligonucleotide or conjugated oligonucleotide of the invention with a pharmaceutically acceptable diluent, solvent, carrier, salt and/or adjuvant.

Pharmaceutical Salt

The compounds according to the present invention may exist in the form of their pharmaceutically acceptable salts. The term "pharmaceutically acceptable salt" refers to conventional acid-addition salts or base-addition salts that retain the biological effectiveness and properties of the compounds of the present invention and are formed from suitable non-toxic organic or inorganic acids or organic or inorganic bases. Acid-addition salts include for example those derived from inorganic acids such as hydrochloric acid, hydrobromic acid, hydroiodic acid, sulfuric acid, sulfamic acid, phosphoric acid and nitric acid, and those derived from organic acids such as p-toluenesulfonic acid, salicylic acid, methanesulfonic acid, oxalic acid, succinic acid, citric acid, malic acid, lactic acid, fumaric acid, and the like. Base-addition salts include those derived from ammonium, potassium, sodium and, quaternary ammonium hydroxides, such as for example, tetramethyl ammonium hydroxide. The chemical modification of a pharmaceutical compound into a salt is a technique well known to pharmaceutical chemists in order to obtain improved physical and chemical stability, hygroscopicity, flowability and solubility of compounds. It is for example described in Bastin, Organic Process Research & Development 2000, 4, 427-435 or in Ansel, In: Pharmaceutical Dosage Forms and Drug Delivery Systems, 6th ed. (1995), pp. 196 and 1456-1457. For example, the pharmaceutically acceptable salt of the compounds provided herein may be a sodium salt.

In a further aspect the invention provides a pharmaceutically acceptable salt of the antisense oligonucleotide or a conjugate thereof. In a preferred embodiment, the pharmaceutically acceptable salt is a sodium or a potassium salt.

Pharmaceutical Composition

In a further aspect, the invention provides pharmaceutical compositions comprising any of the aforementioned oligonucleotides and/or oligonucleotide conjugates or salts thereof and a pharmaceutically acceptable diluent, carrier, salt and/or adjuvant. A pharmaceutically acceptable diluent includes phosphate-buffered saline (PBS) and pharmaceutically acceptable salts include, but are not limited to, sodium and potassium salts. In some embodiments the pharmaceutically acceptable diluent is sterile phosphate buffered saline or sterile sodium carbonate buffer.

In some embodiments the oligonucleotide of the invention is in the form of a solution in the pharmaceutically acceptable diluent, for example dissolved in PBS or sodium carbonate buffer.

The oligonucleotide may be pre-formulated in the solution or in some embodiments may be in the form of a dry powder (e.g. a lyophilized powder) which may be dissolved in the in the pharmaceutically acceptable diluent prior to administration. Suitably, for example the oligonucleotide may be dissolved in a concentration of 0.1-100 mg/ml, such as 1-10 mg/the pharmaceutically acceptable diluent.

In some embodiments the oligonucleotide of the invention is formulated in a unit dose of between 0.5-100 mg, such as 1 mg-50 mg, or 2-25 mg.

Oligonucleotides or oligonucleotide conjugates of the invention may be mixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

Pharmaceutical compositions, such as solutions, may be sterilized by conventional sterilization techniques, or may be sterile filtered. The resulting solutions may be packaged for use as is, or lyophilized, the lyophilized preparation being combined with a sterile aqueous carrier prior to administration. The pH of the preparations typically will be between 3 and 11, more preferably between 5 and 9 or between 6 and 8, and most preferably between 7 and 8, such as 7 to 7.5. The resulting compositions in solid form may be packaged in multiple single dose units, each containing a fixed amount of the above-mentioned agent or agents, such as in a sealed package of tablets or capsules. The composition in solid form can also be packaged in a container for a flexible quantity, such as in a squeezable tube designed for a topically applicable cream or ointment.

In some embodiments, the oligonucleotide or oligonucleotide conjugate of the invention is a prodrug. In particular with respect to oligonucleotide conjugates the conjugate moiety is cleaved off the oligonucleotide once the prodrug is delivered to the site of action, e.g. the target cell.

Applications

The oligonucleotides of the invention may be utilized as research reagents for, for example, diagnostics, therapeutics and prophylaxis.

In research, such oligonucleotides may be used to specifically modulate the synthesis of $Na_v1.7$ or in some aspects $Na_v1.8$ protein in cells (e.g. in vitro cell cultures) and experimental animals thereby facilitating functional analysis of the target or an appraisal of its usefulness as a target for therapeutic intervention. Typically the target modulation is achieved by degrading or inhibiting the mRNA producing the protein, thereby prevent protein formation or by degrading or inhibiting a modulator of the gene or mRNA producing the protein.

If employing the oligonucleotide of the invention in research or diagnostics the target nucleic acid may be a cDNA or a synthetic nucleic acid derived from DNA or RNA.

The present invention provides an in vivo or in vitro method for modulating SCN9A expression in a target cell which is expressing SCN9A, said method comprising administering an oligonucleotide of the invention in an effective amount to said cell.

In some embodiments, the target cell, is a mammalian cell in particular a human cell. The target cell may be an in vitro cell culture or an in vivo cell forming part of a tissue in a mammal. In preferred embodiments the target cell is present in the peripheral nervous system, such as the dorsal root ganglion.

In diagnostics the oligonucleotides may be used to detect and quantitate SCN9A expression in cell and tissues by northern blotting, in-situ hybridization or similar techniques.

Therapeutic Applications

The oligonucleotides of the invention, or the conjugates, salts or pharmaceutical compositions of the invention, may be administered to an animal or a human for the prevention or treatment of pain, such as chronic pain, neuropathic pain, inflammatory pain, spontaneous pain, or nociceptive pain. The oligonucleotides of the invention, or the conjugates, salts or pharmaceutical compositions of the invention may be for use as a local analgesic.

The pain which may be treated by the oligonucleotides of the invention, or the conjugates, salts or pharmaceutical compositions of the invention may be pain wherein the pain signal in the peripheral nervous system. Indications associated with pain with a significant peripheral component include for example, diabetic neuropathies, cancer, cranial neuralgia, postherpetic neuralgia and post-surgical neuralgia.

Pain which may be prevented, treated or ameliorated using the oligonucleotide, conjugate, composition or salt of the invention may for example be selected from the group consisting of pain associated with inherited erythromelalgia (EIM), paroxysmal extreme pain disorder (PEPD), trigeminal neuralgia, neurophathic pain, chronic pain, but also general treatment of nociceptive (e.g. decompression of a nerve), neuropathic pain (e.g. diabetic neuropathy), visceral pain, or mixed pain.

The invention provides for the oligonucleotide, conjugate, composition or salt of the invention for the use for the prevention or for the treatment of pain, such as chronic pain, neuropathic pain, inflammatory pain, spontaneous pain, or nociceptive pain.

The invention further relates to use of an oligonucleotide, oligonucleotide conjugate or a pharmaceutical composition of the invention for the manufacture of a medicament for the treatment or prevention of pain, such as chronic pain, neuropathic pain, inflammatory pain, spontaneous pain, or nociceptive pain.

The invention provides for the oligonucleotide, conjugate, composition or salt of the invention for the use as a local analgesic.

The invention provides for the use of the oligonucleotide, conjugate, composition or salt of the invention for manufacture of a local analgesic.

The invention provides for the oligonucleotide, conjugate, composition or salt of the invention for the use for the prevention or for the treatment of pain associated with inherited erythromelalgia (EIM), paroxysmal extreme pain disorder (PEPD), trigeminal neuralgia, neurophathic pain, chronic pain, but also general treatment of nociceptive (e.g. decompression of a nerve), neuropathic pain (e.g. diabetic neuropathy), visceral pain, or mixed pain.

The invention further relates to use of an oligonucleotide, oligonucleotide conjugate or a pharmaceutical composition of the invention for the manufacture of a medicament for the treatment or prevention of pain associated with inherited erythromelalgia (EIM), paroxysmal extreme pain disorder (PEPD), trigeminal neuralgia, neurophathic pain, chronic pain, but also general treatment of nociceptive (e.g. decompression of a nerve), neuropathic pain (e.g. diabetic neuropathy), visceral pain, or mixed pain.

Method of Treatments

The invention provides methods for treating or preventing pain in a subject, such as a human, who is suffering from or is likely to suffer pain, comprising administering a therapeutically or prophylactically effective amount of an oligonucleotide, an oligonucleotide conjugate or a pharmaceutical composition of the invention to a subject who is suffering from or is susceptible to suffering from pain, such as chronic pain, neuropathic pain, inflammatory pain, spontaneous pain, or nociceptive pain.

By way of example, the method of treatment may be in subjects whose are suffering from an indication selected from the group consisting of diabetic neuropathies, cancer, cranial neuralgia, postherpetic neuralgia and post-surgical neuralgia.

The method of the invention may be for treating and relieving pain, such as pain associated with inherited erythromelalgia (EIM), paroxysmal extreme pain disorder (PEPD), trigeminal neuralgia, neurophathic pain, chronic pain, but also general treatment of nociceptive (e.g. decompression of a nerve), neuropathic pain (e.g. diabetic neuropathy), visceral pain, or mixed pain.

The methods of the invention are preferably employed for treatment or prophylaxis against pain which is mediated by $Na_v1.7$, or in some aspects, $Na_v1.7$ and $Na_v1.8$.

Administration

The oligonucleotides or pharmaceutical compositions of the present invention may be administered via parenteral administration.

In some embodiments, the administration route is subcutaneous or intrevenous.

In some embodiments the administration route is selected from the group consisting of intravenous, subcutaneous, intra-muscular, intracerebral, epidural, intracerebroventricular intraocular, intrathecal administration, or transforaminal administration).

In some advantageous embodiments, the administration is via intrathecal administration, or epidural administration or transforaminal administration.

Advantageously, the oligonucleotide or pharmaceutical compositions of the present invention are administered intrathecally.

The invention also provides for the use of the oligonucleotide of the invention, or conjugate thereof, such as pharmaceutical salts or compositions of the invention, for the manufacture of a medicament for the prevention or treatment of pain wherein the medicament is in a dosage form for intrathecal administration.

The invention also provides for the use of the oligonucleotide or oligonucleotide conjugate of the invention as described for the manufacture of a medicament for the manufacture of a medicament for the prevention or treatment of pain wherein the medicament is in a dosage form for intrathecal administration.

The invention also provides for the oligonucleotide of the invention, or conjugate thereof, such as pharmaceutical salts or compositions of the invention, for use as a medicament for the prevention or treatment of pain wherein the medicament is in a dosage form for intrathecal administration.

The invention also provides for the oligonucleotide or oligonucleotide conjugate of the invention, for use as a medicament for the prevention or treatment of pain wherein the medicament is in a dosage form for intrathecal administration.

Combination Therapies

In some embodiments the oligonucleotide, oligonucleotide conjugate or pharmaceutical composition of the invention is for use in a combination treatment with another therapeutic agent. The therapeutic agent can for example be the standard of care for the diseases or disorders described above. In some embodiments the compound of the invention is used in combination with small molecule analgesics which may be administered concurrently or independently of the administration of the compound or compositions of the invention. An advantage of a combination therapy of the compounds of the invention with small molecule analgesics is that small molecule analgesics have a rapid onset of pain relieving activity, typically with a short duration of action (hours-days), whereas the compounds of the invention has a delayed onset of activity (typically a few days or even a week+), but with a long duration of action (weeks-months, e.g. 2+, 3+ or 4 months+).

Embodiments—The Following is a List of Exemplary Embodiments of the Invention

1. An antisense oligonucleotide of 10 to 30 nucleotides in length, which comprises a contiguous nucleotide sequence of 10 to 30 nucleotides in length with at least 90% complementarity, such as 100% complementarity, to SEQ ID NO: 1.
2. The antisense oligonucleotide of embodiment 2, wherein the contiguous nucleotide sequence is at least 90% complementary, such as 100% complementary to a region of SEQ ID NO 1 selected from the group consisting of the sequences shown in Target Sequence List 1.
3. The antisense oligonucleotide of embodiment 1 or 2 wherein the contiguous nucleotide sequence is at least 90% complementary, such as 100% complementary to a region of SEQ ID NO 1 selected from the group consisting of the sequences shown in Target Sequence List 2.
4. The antisense oligonucleotide of embodiment 1-3 wherein the contiguous nucleotide sequence is at least 90% complementary, such as 100% complementary to a region of SEQ ID NO 1 selected from the group consisting of Target Sequence List 3.
5. The antisense oligonucleotide of embodiment 1-4 wherein the contiguous nucleotide sequence is at least 90% complementary, such as 100% complementary to a region of SEQ ID NO 1 selected from the group consisting of Target List 4.
6. The antisense oligonucleotide of embodiment 1-5, wherein the contiguous nucleotide sequence comprises a sequence which is 100% complementary to at least at least 10 contiguous nucleotides present in a sequence selected from the group consisting of SEQ ID NO 17-49.
7. The antisense oligonucleotide of embodiment 1-5 wherein the contiguous nucleotide sequence comprises a sequence which is 100% complementary to at least at least 12 contiguous nucleotides present in a sequence selected from the group consisting of SEQ ID NO 17-49.
8. The antisense oligonucleotide of embodiment 1-6 wherein the contiguous nucleotide sequence comprises a sequence which is 100% complementary to at least at least 14 contiguous nucleotides present in a sequence selected from the group consisting of SEQ ID NO 17-49.
9. The antisense oligonucleotide of embodiment 1-7 wherein the contiguous nucleotide sequence is 100% complementary to a sequence selected from the group consisting of SEQ ID NO 17-49.
10. The antisense oligonucleotide of any one of embodiments 1-9, wherein the contiguous nucleotide sequence comprises at least 10 contiguous nucleotides present in a sequence selected from the group consisting of SEQ ID NO 50-641, or 642-650.
11. The antisense oligonucleotide of any one of embodiments 1-9, wherein the contiguous nucleotide sequence comprises at least 12 contiguous nucleotides present in a sequence selected from the group consisting of SEQ ID NO 50-641, or 642-650.
12. The antisense oligonucleotide of any one of embodiments 1-9, wherein the contiguous nucleotide sequence comprises at least 14 contiguous nucleotides present in a sequence selected from the group consisting of SEQ ID NO 50-641, or 642-650.
13. The antisense oligonucleotide of any one of embodiments 1-9, wherein the contiguous nucleotide sequence is a sequence selected from the group consisting of SEQ ID NO 50-641, or 642-650.
14. The antisense oligonucleotide of any one of embodiments 1-13, one or more nucleoside in the contiguous nucleotide sequence is a 2' sugar modified nucleoside.
15. The antisense oligonucleotide of embodiment 14, wherein the one or more 2' sugar modified nucleoside is independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA and LNA nucleosides.
16. The antisense oligonucleotide of any one of embodiments 1-15, wherein the antisense oligonucleotide or contiguous nucleotide sequence thereof comprises one or more LNA nucleoside.
17. The antisense oligonucleotide of any one of embodiments 1-16, wherein at least one internucleoside linkage in the contiguous nucleotide sequence is a phosphorothioate internucleoside linkages.
18. The antisense oligonucleotide of any one of embodiments 1-17, wherein all the internucleoside linkages within the contiguous nucleotide sequence are phosphorothioate internucleoside linkages.
19. The antisense oligonucleotide of any one of embodiments embodiment 1-18, wherein the oligonucleotide is capable of recruiting RNase H, such as human RNaseH1.
20. The antisense oligonucleotide of any one of embodiments 1-19, wherein the antisense oligonucleotide, or contiguous nucleotide sequence thereof, consists or comprises a gapmer, such as a gapmer of formula 5'-F-G-F'-3', wherein region G is a region comprising a contiguous sequence of nucleotides capable of recruiting RNaseH, and regions F and F' each comprise at least one 2' sugar modified nucleoside.
21. The antisense oligonucleotide according to embodiment 20, wherein region G comprises of 6-16 DNA nucleosides and at least one of region F and F' comprises at least one LNA nucleoside, or both region F and F' comprise at least one LNA nucleoside.
22. The antisense oligonucleotide according to any one of embodiments 1-21, wherein the antisense oligonucleotide is a compound selected from the group consisting of CMP ID NO 50_1; 51_1; 52_1; 53_1; 54_1; 55_1; 56_1; 57_1; 58_1; 59_1; 60_1; 61_1; 62_1; 63_1; 64_1; 65_1; 66_1; 67_1; 68_1; 69_1; 70_1; 71_1; 72_1; 73_1; 74_1; 75_1; 76_1; 77_1; 78_1; 79_1; 80_1; 81_1; 82_1; 83_1; 84_1; 85_1; 86_1; 87_1; 88_1; 89_1; 90_1; 91_1; 92_1; 93_1; 94_1; 95_1; 96_1; 97_1; 98_1; 99_1; 100_1; 101_1; 102_1; 103_1; 104_1; 105_1; 106_1; 107_1; 108_1; 109_1; 110_1; 111_1; 112_1; 113_1; 114_1; 115_1; 116_1; 117_1; 118_1; 119_1; 120_1; 121_1; 122_1; 123_1; 124_1; 125_1; 126_1; 127_1; 128_1; 129_1; 130_1; 131_1; 132_1; 133_1; 134_1; 135_1; 136_1; 137_1; 138_1; 139_1; 140_1; 141_1; 142_1; 143_1; 144_1; 145_1; 146_1; 147_1; 148_1; 149_1; 150_1; 151_1; 152_1; 153_1; 154_1; 155_1; 156_1; 157_1; 158_1; 159_1; 160_1; 161_1; 162_1; 163_1; 164_1; 165_1; 166_1; 167_1; 168_1; 169_1; 170_1; 171_1; 172_1; 173_1; 174_1; 175_1; 176_1; 177_1; 178_1; 179_1; 180_1; 181_1; 182_1; 183_1; 1841; 185_1; 186_1; 1871; 1881; 189_1; 190_1; 191_1; 192_1; 193_1; 194_1; 195_1; 196_1; 197_1; 198_1; 199_1; 200_1; 201_1; 202_1; 203_1; 204_1; 205_1; 206_1; 207_1; 208_1; 209_1; 210_1; 211_1; 212_1; 213_1; 214_1; 215_1; 216_1; 217_1; 218_1; 219_1; 220_1; 221_1; 222_1; 223_1; 224_1; 225_1; 226_1; 227_1; 228_1; 229_1;

230_1; 231_1; 232_1; 233_1; 234_1; 235_1; 236_1; 237_; 238_1; 239_1; 240_1; 241_1; 242_1; 243_1; 244_1; 245_1; 246_1; 247_1; 248_1; 249_1; 250_1; 25_1; 252_1; 253_1; 254_1; 255_1; 256_1; 257_1; 258_1; 259_1; 260_1; 261_1; 262_1; 263_1; 264_1; 265_1; 266_1; 267_1; 268_1; 269_1; 270_1; 271_1; 272_1; 273_1; 274_1; 275_1; 276_1; 277_1; 278_1; 279_1; 280_1; 281_1; 282_1; 283_1; 284_1; 285_1; 286_1; 287_1; 288_1; 289_1; 290_1; 291_1; 292_1; 293_1; 294_1; 295_1; 296_1; 297_1; 298_1; 299_1; 300_1; 301_1; 302_1; 303_1; 304_1; 305_1; 306_1; 307_1; 308_1; 309_1; 310_1; 311_1; 312_1; 313_1; 314_1; 315_1; 316_1; 317_1; 318_1; 319_1; 320_1; 321_1; 322_1; 323_1; 324_1; 325_1; 326_1; 327_1; 328_1; 329_1; 330_1; 331_1; 332_1; 333_1; 334_1; 335_1; 336_1; 337_1; 338_1; 339_1; 340_1; 341_1; 342_1; 343_1; 344_1; 345_1; 346_1; 347_1; 348_1; 349_1; 350_1; 351_1; 352_1; 353_1; 354_1; 355_1; 356_1; 357_1; 358_1; 359_1; 360_1; 361_1; 362_1; 363_1; 364_1; 365_1; 366_1; 367_1; 368_1; 369_1; 370_1; 371_1; 372_1; 373_1; 3741; 3751; 376_1; 377_1; 378_1; 379_1; 380_1; 381_1; 382_1; 383_1; 384_1; 385_1; 386_1; 387_1; 388_1; 389_1; 390_1; 391_1; 392_1; 393_1; 394_1; 395_1; 396_1; 3971; 398_1; 399_1; 400_1; 401_1; 402_1; 403_1; 404_1; 405_1; 406_1; 407_1; 408_1; 409_1; 410_1; 411_1; 412_1; 413_1; 414_1; 415_1; 416_1; 417_1; 418_1; 419_1; 420_1; 421_1; 422_1; 423_1; 424_1; 425_1; 426_1; 427_1; 428_1; 429_1; 430_1; 431_1; 432_1; 433_1; 434_1; 435_1; 436_1; 437_1; 438_1; 439_1; 440_1; 441_1; 442_1; 443_1; 444_1; 445_1; 446_1; 447_1; 448_1; 449_1; 450_1; 451_1; 452_1; 453_1; 454_1; 455_1; 456_1; 457_1; 458_1; 459_1; 460_1; 461_1; 462_1; 463_1; 464_1; 465_1; 466_1; 467_1; 468_1; 469_1; 470_1; 471_1; 472_1; 473_1; 474_1; 475_1; 476_1; 477_1; 478_1; 479_1; 480_1; 481_1; 482_1; 483_1; 484_1; 485_1; 486_1; 487_1; 488_1; 489_1; 490_1; 491_1; 492_1; 493_1; 494_1; 495_1; 496_1; 4971; 498_1; 499_1; 500_1; 501_1; 502_1; 503_1; 504_1; 505_1; 506_1; 507_1; 508_1; 509_1; 510_1; 511_1; 512_1; 512_2; 512_3; 513_1; 513_2; 513_3; 513_4; 514_1; 514_2; 514_3; 514_4; 515_1; 515_2; 515_3; 515_4; 515_5; 515_6; 516_1; 516_2; 516_3; 516_4; 516_5; 516_6; 516_7; 517_1; 517_2; 517_3; 517_4; 517_5; 517_6; 517_7; 517_8; 518_1; 518_2; 518_3; 518_4; 518_5; 518_6; 519_1; 519_2; 519_3; 519_4; 519_5; 519_6; 520_1; 520_2; 520_3; 520_4; 520_5; 521_1; 521_2; 521_3; 521_4; 521_5; 522_1; 522_2; 522_3; 522_4; 523_1; 523_2; 523_3; 523_4; 523_5; 524_1; 525_1; 526_1; 5271; 528_1; 529_1; 530_1; 531_1; 532_1; 533_1; 534_1; 535_1; 536_1; 537_1; 538_1; 539_1; 540_1; 541_1; 542_1; 543_1; 544_1; 545_1; 546_1; 547_1; 548_1; 549_1; 550_1; 551_1; 552_1; 553_1; 554_1; 555_1; 556_1; 557_1; 558_1; 559_1; 560_1; 561_1; 562_1; 563_1; 564_1; 565_1; 566_1; 567_1; 568_1; 569_1; 570_1; 571_1; 572_1; 573_1; 574_1; 575_1; 576_1; 577_1; 578_1; 579_1; 580_1; 581_1; 582_1; 583_1; 584_1; 585_1; 586_1; 587_1; 588_1; 589_1; 590_1; 591_1; 592_1; 593_1; 594_1; 595_1; 596_1; 597_1; 598_1; 599_1; 600_1; 601_1; 602_1; 603_1; 604_1; 605_1; 606_1; 607_1; 608_1; 609_1; 610_1; 611_1; 612_1; 613_1; 614_1; 615_1; 616_1; 617_1; 618_1; 619_1; 620_1; 621_1; 622_1; 623_1; 624_1; 625_1; 626_1; 627_1; 628_1; 629_1; 630_1; 631_1; 632_1; 633_1; 634_1; 635_1; 636_1; 637_1; 638_1; 639_1; 640_1; and 641_1; or 642_1; 643_1; 644_1; 645_1; 646_1; 647_1; 648_1; 649_1; 650_1

23. The antisense oligonucleotide according to any one of embodiments 1-21, wherein the antisense oligonucleotide comprises a contiguous nucleotide sequence comprising at least 10 or at least 12 contiguous nucleotides of a sequence selected from the group consisting of 51, 59, 127, 161, 67, 106, 72, 124, 163, 99, 125, 110, 65, 94, 64, 57, 136, 158, 159, 356, 197,132, 83, 76, 130, 135, 77, 186, 105, 445, 325, 265, 200, 288, 346, 86, 281, 339, 256, 289, 414, 286, 241, 82, 475, 91, 50, 97, 322, 148, 443, 251, 451, 179, 466, 357, 109, 472, 471, 376, 413, 270, 379, 416, 311, 411, 368, 333, 347, 152, 89, 380, 390, 429, 63, 90, 415, 199, 503, 476, 92, 268, 371, 302, 485, 205, 274, 122, 419, 470, 498, 156, 478, 393, 312, 287, 96, 226, 71, 137, 365, 58, 370, 280, 385, 442, 134, 463, 140, 440, 230, 310, 479, 363, 340, 495, 467, 444, 418, 338, 335, 496, 196, 317, 341, 406, 330, 173, 377, 474, 482, 282, 266, 73, 257, 342, 190, 492, 87, 188, 456, 372, 417, 404, 239, 206, 433, 486, 175, 461, 56, 408, 334, 504, 453, 222, 410, 104, 460, 439, 255, 489, 203, 398, 171, 407, 172, 412, 321, 305, 328, 120, 434, 449, 350, 487, 146, 420, 426, 352, 150, 316, 353, 469, 306, 384, 155, 450, 279, 267, 337, 184, 459, 360, 75, 468, 180, 245, 387, 345, 98, 435, 295, 369, 218, 182, 448, 300, 481, 427, 207, 367, 240, 231, 364, 355, 431, 497, 397, 465, 271, 502, 151, 178, 499, 421, 131, 309, 491, 261, 121, 128, 84, 304, 264, 493, 185, 237, 139, 441, 169, 160, 102, 296, 164, 362, 500, and 100.

24. The antisense oligonucleotide according to any one of embodiments 1-21, wherein the antisense oligonucleotide comprises a contiguous nucleotide sequence comprising at least 10 or at least 12 contiguous nucleotides of a sequence selected from the group consisting of 51, 59, 127, 161, 67, 106, 72, 124, 163, 99, 125, 110, 65, 94, 64, 57, 136, 158, 159, 356, 197, 132, 83, 76, 130, 135, 77, 186, 105, 445, 325, 265, 200, 288, 346, 86, 281, 339, 256, 289, 414, 286, 241, 82, 475, 91, 50, 97, 322, 148, 443, 251, 451, 179, 466, 357, 109, 472, 471, 376, 413, 270, 379, 416, 311, 411, 368, 333, 347, 152, 89, 380, 390, 429, 63, 90, 415, 199, 503, 476, 92, 268, 371, 302, 485, 205, 274, 122, 419, 470, 498, 156, 478, 393, 312, 287, 96, 226, 71, 137, 365, 58, 370, 280, 385, 442, 134, 463, 140, 440, 230, 310, 479, 363, 340, 495, 467, 444, 418, 338, 335, 496, 196, 317, 341, 406, 330, 173, 377, 474, 482, 282, 266, 73, 257, 342, 190, 492, 87, 188, 456, 372, 417, 404, 239, 206, 433, 486, 175, 461, 56, 408, 334, 504, 453, 222, 410, 104, 460, 439, 255, 489, 203, 398, 171, 407, 172, 412, 321, 305, 328, 120, 434, 449, 350, 487, 146, 420, 426, 352, 150, 316, 353, 469, 306, 384, 155, 450, 279, 267, 337, 184, 459, 360, 75, 468, 180, 245, 387, 345, 98, 435, 295, 369, 218, 182, 448, 300, 481, 427, and 207.

25. The antisense oligonucleotide according to any one of embodiments 1-21, wherein the antisense oligonucleotide comprises a contiguous nucleotide sequence comprising at least 10 or at least 12 contiguous nucleotides of a sequence selected from the group consisting of 51, 59, 127, 161, 67, 106, 72, 124, 163, 99, 125, 110, 65, 94, 64, 57, 136, 158, 159, 356, 197, 132, 83, 76, 130, 135, 77, 186, 105, 445, 325, 265, 200, 288, 346, 86, 281, 339, 256, 289, 414, 286, 241, 82, 475, 91, 50, 97, 322, 148, 443, 251, 451, 179, 466, 357, 109, 472, 471, 376, 413, 270, 379, 416, 311, 411, 368, 333, 347, 152, 89, 380, 390, 429, 63, 90, 415, 199, 503, 476, 92, 268, 371, 302, 485, 205, 274, 122, 419, 470, 498, 156, 478, 393, 312, 287, 96, 226, 71, 137, 365, 58, 370, 280, 385, 442, 134, 463, 140, 440, 230, 310, 479, 363, 340, 495, 467, 444, 418, 338, 335, 496, 196, 317, 341, 406, 330, 173, 377, 474, 482, 282, 266, 73, 257, 342, 190, 492, 87, 188, 456, 372, 417, 404, 239, 206, 433, 486, 175, 461, 56, 408, 334, 504, and 453.

26. The antisense oligonucleotide according to any one of embodiments 1-21, wherein the antisense oligonucleotide comprises a contiguous nucleotide sequence comprising at least 10 or at least 12 contiguous nucleotides of a sequence selected from the group consisting of 51, 59, 127, 161, 67, 106, 72, 124, 163, 99, 125, 110, 65, 94, 64, 57, 136, 158, 159, 356, 197, 132, 83, 76, 130, 135, 77, 186, 105, 445, 325, 265, 200, 288, 346, 86, 281, 339, 256, 289, 414, 286, 241, 82, 475, 91, 50, 97, 322, 148, 443, 251, 451, 179, 466, 357, 109, 472, 471, 376, 413, 270, 379, 416, 311, 411, 368, 333, 347, 152, 89, 380, 390, 429, 63, 90, 415, 199, 503, 476, 92, 268, 371, 302, 485, 205, and 274.

27. The antisense oligonucleotide according to any one of embodiments 1-21, wherein the antisense oligonucleotide comprises a contiguous nucleotide sequence comprising at least 10 or at least 12 contiguous nucleotides of a sequence selected from the group consisting of 51, 59, 127, 161, 67, 106, 72, 124, 163, 99, 125, 110, 65, 94, 64, 57, 136, 158, 159, 356, 197, 132, 83, 76, 130, 135, 77, 186, 105, 445, and 325, such as a compound selected from the group consisting of 51, 59, 127, 161, 67, 106, 72, 124, 163, 99, 125, and 110.

28. The antisense oligonucleotide according to any one of embodiments 1-21, wherein the antisense oligonucleotide comprises a contiguous nucleotide sequence comprising at least 10 or at least 12 contiguous nucleotides of a sequence selected from the group consisting of is a compound selected from the group consisting of SEQ ID NOs 512-641.

29. The antisense oligonucleotide according to any one of embodiments 23-28 wherein the contiguous nucleotide sequence of the antisense oligonucleotide comprises at least 14 contiguous nucleotides of the selected sequence, or consists of the selected sequence.

30. A conjugate comprising the antisense oligonucleotide according to any one of embodiments 1-29, and at least one conjugate moiety covalently attached to said oligonucleotide.

31. A pharmaceutically acceptable salt of the antisense oligonucleotide according to any one of embodiments 1-29, or the conjugate according to embodiment 30.

32. A pharmaceutical composition comprising the antisense oligonucleotide of embodiment 1-29 or the conjugate of embodiment 30 and a pharmaceutically acceptable diluent, solvent, carrier, salt and/or adjuvant.

33. An in vivo or in vitro method for modulating SCN9A expression in a target cell which is expressing SCN9A, said method comprising administering an antisense oligonucleotide of any one of embodiments 1-29 or the conjugate of embodiment 30 or the pharmaceutical salt or composition of embodiment 31 or 32 in an effective amount to said cell.

34. A method for treating or preventing pain in a subject such as a human, who is suffering from or is likely to suffer pain, comprising administering a therapeutically or prophylactically effective amount of an antisense oligonucleotide of any one of embodiments 1-29 or the conjugate of embodiment 30 or the pharmaceutical salt or composition of embodiment 31 or 32, such as to prevent or alleviate the pain.

35. The method of embodiment 34, wherein the pain is either
   i) chronic pain, neuropathic pain, inflammatory pain, spontaneous pain, or nociceptive pain; or
   ii) pain caused by or associated with a disorder selected from the group consisting of diabetic neuropathies, cancer, cranial neuralgia, postherpetic neuralgia and post-surgical neuralgia; or
   iii) pain caused by or associated with inherited erythromelalgia (EIM) or paroxysmal extreme pain disorder (PEPD) or trigeminal neuralgia; or
   iv) neurophathic pain, chronic pain, but also general treatment of nociceptive pain (e.g. decompression of a nerve), or neuropathic pain (e.g. diabetic neuropathy), visceral pain, or mixed pain.

36. The oligonucleotide of any one of embodiments 1-29 or the conjugate according to embodiment 30 or the pharmaceutical salt or composition of embodiment 31 or 32 for use in medicine.

37. The oligonucleotide of any one of embodiments 1-29 or the conjugate according to embodiment 30 or the pharmaceutical salt or composition of embodiment 31 or 32 for use in the treatment or prevention or alleviation of pain, such as the pain as defined according to parts I), ii), iii) or iv) of embodiment 35.

38. The use of an oligonucleotide of any one of embodiments 1-29 or the conjugate according to embodiment 30 or the pharmaceutical salt or composition of embodiment 31 or 32, for the preparation of a medicament for the treatment, prevention or alleviation of pain, such as the pain as defined according to parts 1), ii), iii) or iv) of embodiment 35.

EXAMPLES

Oligonucleotide Synthesis

Compounds are listed in the Compound Table, which also illustrates the nucleobase sequence, complementary target sequence region on SEQ ID NO 1 (start and end), the gapmer design, the Tm (dG), and the level of remaining mRNA in the cells after treatment with the compounds (see Example 1 below) Oligonucleotide synthesis is generally known in the art. Below is a protocol which may be applied. The oligonucleotides of the present invention may have been produced by slightly varying methods in terms of apparatus, support and concentrations used.

Oligonucleotides are synthesized on uridine universal supports using the phosphoramidite approach on an Oligomaker 48 at 1 µmol scale. At the end of the synthesis, the oligonucleotides are cleaved from the solid support using aqueous ammonia for 5-16 hours at 60° C. The oligonucleotides are purified by reverse phase HPLC (RP-HPLC) or by solid phase extractions and characterized by UPLC, and the molecular mass is further confirmed by ESI-MS.

Elongation of the Oligonucleotide:

The coupling of β-cyanoethyl-phosphoramidites (DNA-A(Bz), DNA-G(ibu), DNA-C(Bz), DNA-T, LNA-5-methyl-C(Bz), LNA-A(Bz), LNA-G(dmf), or LNA-T) is performed by using a solution of 0.1 M of the 5'-O-DMT-protected amidite in acetonitrile and DCI (4,5-dicyanoimidazole) in acetonitrile (0.25 M) as activator. For the final cycle a phosphoramidite with desired modifications can be used, e.g. a C6 linker for attaching a conjugate group or a conjugate group as such. Thiolation for introduction of phosphorthioate linkages is carried out by using xanthane hydride (0.01 M in acetonitrile/pyridine 9:1). Phosphordiester linkages can be introduced using 0.02 M iodine in THF/Pyridine/water 7:2:1. The rest of the reagents are the ones typically used for oligonucleotide synthesis.

For post solid phase synthesis conjugation a commercially available C6 aminolinker phorphoramidite can be used in the last cycle of the solid phase synthesis and after deprotection and cleavage from the solid support the aminolinked deprotected oligonucleotide is isolated. The conjugates are introduced via activation of the functional group using standard synthesis methods.

Purification by RP-HPLC:

The crude compounds are purified by preparative RP-HPLC on a Phenomenex Jupiter C18 10μ 150×10 mm column. 0.1 M ammonium acetate pH 8 and acetonitrile is used as buffers at a flow rate of 5 mL/min. The collected fractions are lyophilized to give the purified compound typically as a white solid.

Abbreviations

DCI: 4,5-Dicyanoimidazole
DCM: Dichloromethane
DMF: Dimethylformamide
DMT: 4,4'-Dimethoxytrityl
THF: Tetrahydrofurane
Bz: Benzoyl
Ibu: Isobutyryl
RP-HPLC: Reverse phase high performance liquid chromatography $T_m$ Assay:

Oligonucleotide and RNA target (phosphate linked, PO) duplexes are diluted to 3 mM in 500 ml RNase-free water and mixed with 500 ml 2×$T_m$-buffer (200 mM NaCl, 0.2 mM EDTA, 20 mM Naphosphate, pH 7.0). The solution is heated to 95° C. for 3 min and then allowed to anneal in room temperature for 30 min. The duplex melting temperatures ($T_m$) is measured on a Lambda 40 UV/VIS Spectrophotometer equipped with a Peltier temperature programmer PTP6 using PE Templab software (Perkin Elmer). The temperature is ramped up from 20° C. to 95° C. and then down to 25° C., recording absorption at 260 nm. First derivative and the local maximums of both the melting and annealing are used to assess the duplex $T_m$.

Example 1: In Vitro Reduction of Nav1.7 in SK-N-AS Human Cell Line Using Oligonucleotides LNA modified oligonucleotides targeting human Nav1.7 were tested for their ability to reduce Nav1.7 mRNA expression in human SK-N-AS neuroblastoma cells acquired from ATCC (CRL-2137). SK-N-AS cells (ECACC-94092302) were cultured according to the vendor guidelines in Dulbecco's Modified Eagle's Medium, supplemented with 0.1 mM Non-Essential Amino Acids (NEAA) and fetal bovine serum to a final concentration of 10%. Cells were cultured at 37° C., 5% C02 and 95% humidity in an active evaporation incubator (Thermo C10). Cells were seeded at a density of 9300 cells per well (96-well plate) in 95 ul of SK-N-AS cell culture medium and left to attach for 24 hours in the incubator. Hereafter, oligos diluted to a final concentration of 5 μM in PBS (5.0 μl) were added to the cell cultures from pre-made 96-well dilution plates. The cell culture plates were incubated for 96 hours in the incubator.

After incubation, cells were harvested by removal of media followed by cell lysis and RNA purification using QIAGEN RNeasy 96 Kit (cat 74181), following manufacturers protocol. RNA was diluted 10 fold in water prior to the one-step qPCR reaction. For one-step qPCR reaction qPCR-mix (qScript™ XLT One-Step RT-qPCR ToughMix® Low ROX from QuantaBio, cat.no 95134-500) and QPCR was run as duplex QPCR using assays from Integrated DNA technologies for $Na_v1.7$ (Hs.PT.58.20989243) and GUSB (Hs.PT.58v.27737538).

The reactions were then mixed in a qPCR plate (MICROAMP®optical 384 well, 4309849). After sealing, the plate was given a quick spin, 1000 g for 1 minute at RT, and transferred to a Viia™ 7 system (Applied Biosystems, Thermo), and the following PCR conditions used: 50° C. for 15 minutes; 95° C. for 3 minutes; 40 cycles of: 95° C. for 5 see followed by a temperature decrease of 1.6° C./sec followed by 60° C. for 45 sec. The data was analyzed using the QuantStudio™ Real_time PCR Software and quantity calculated by the delta delta Ct method (Quantity=2^(-Ct) *1000000000). Quantity is normalized to the calculated quantity for the housekeeping gene assay (GUSB) run in the same well. Relative Target Quantity=QUANTITY_target/QUANTITY_housekeeping (RNA knockdown) was calculated for each well by division with the mean of all PBS-treated wells on the same plate. Normalised Target Quantity=(Relative Target Quantity/[mean] Relative Target Quantity]_pbs_wells)*100.

Compounds based on SEQ ID NOs 512-641 are being evaluated in the above assay.

The target knock-down data is presented in the following Compound Table:

In the Compound table, motif sequences represent the contiguous sequence of nucleobases present in the oligonucleotide.

Design refers to the gapmer design, F-G-F', wherein G is a region of DNA nucleosides, and F and F' are regions of LNA nucleosides.

Oligonucleotide compound represent specific designs of a motif sequence. Capital letters represent beta-D-oxy LNA nucleosides, lowercase letters represent DNA nucleosides, all LNA C are 5-methyl cytosine, all internucleoside linkages are phosphorothioate internucleoside linkages.

Example 2: In Vitro Reduction of Nav1.8 Alone or in Combination with Reduction of Nav1.7 in Modified SK-N-AS Human Cell Line (CRISPR Activation of Nav1.8) Using Oligonucleotides Activation of Nav1.8 expression in SK-N-AS cells:

SK-N-AS cells were transduced with lentiviral particles coding for hCMV-Blast-dCas9-VPR (#VCAS11918, Dharmacon) at 0.5 MOI, and selected with Blasticidin at 2 ug/ml for 10 days.

SK-N-AS stably expressing dCas9-VPR protein were subsequently engineered to express Nav1.8 specific sgRNA. Briefly, an expression cassette driven by U6 promoter has been synthesized as a gBlock and then subcloned in PiggyBac vector (#PB511B-1, System Biosciences). The identity of the vector has been Sanger-sequencing validated. Stable integration of the U6 driven cassette expressing $Na_v1.8$ specific sgRNA was obtained with the use of the transposase expression plasmid (#PB210PA-1, System Biosciences) following the manufacturer's instructions. Selection of sgRNA stably expressing cells was obtained in presence of Puromycin at 2 ug/ml for 10 days.

The sgRNA sequence used in $Na_v1.8$ activation is GGCAAGCTGTCACCTCTCTG (SEQ ID NO 652).

The full sequence of the U6 promoter-sgRNA is the following:

(SEQ ID NO 653)
GAGGGCCTATTTCCCATGATTCCTTCATATTTGCATATACGATACAAGGC

TGTTAGAGAGATAATTAGAATTAATTTGACTGTAAACACAAAGATATTAG

TACAAAATACGTGACGTAGAAAGTAATAATTTCTTGGGTAGTTTGCAGTT

TTAAAATTATGTTTTAAAATGGACTATCATATGCTTACCGTAACTTGAAA

GTATTTCGATTTCTTGGCTTTATATATCTTGTGGAAAGGACGAAACACCG

GGCAAGCTGTCACCTCTCTGGTTTTAGAGCTAGAAATAGCAAGTTAAAAT

AAGGCTAGTCCGTTATCAACTTGAAAAAGTGGCACCGAGTCGGTGCTTTT

TTT.

LNA modified oligonucleotides targeting human $Na_v1.8$ singlehanded or also $Na_v1.7$ as a dual-specific compound were tested for their ability to reduce the expression of their respective mRNA targets in human SK-N-AS neuroblastoma cells acquired from ATCC (CRL-2137). The SK-N-AS cells (ECACC-94092302) have underwent an activation of transcription of $Na_v1.8$ using CRISPR activation (CRISPRa) as described above. The modified SK-N-AS cells were cultured according to the vendor guidelines for the parent cell line in Dulbecco's Modified Eagle's Medium, supplemented with 0.1 mM Non-Essential Amino Acids (NEAA), fetal bovine serum to a final concentration of 10% along with Blasticidin (2.5 μg/ml) and Puromycin (1 μg/ml). Cells were cultured at 37° C., 5% $CO_2$ and 95% humidity in an active evaporation incubator (Thermo C10). Cells were seeded at a density of 10,000 cells per well (96-well plate) in 190 ul of SK-N-AS cell culture medium and left to attach for 4 hours in the incubator. Hereafter, oligos were diluted in pre-made 96-well dilution plates to the desired concentration and 10 μl hereof was added to the cell culture plate for a final concentration of 10 μM. The cell culture plates were incubated for 72 hours in the incubator.

After incubation, cells were harvested by removal of media followed by cell lysis and RNA purification using QIAGEN RNeasy 96 Kit (cat 74181), following manufacturers protocol. RNA was diluted 10 fold in water prior to the one-step qPCR reaction. For one-step qPCR reaction qPCR-mix (qScript™ XLT One-Step RT-qPCR ToughMix® Low ROX from QuantaBio, cat.no 95134-500) and QPCR was run as duplex QPCR using assays from Integrated DNA technologies for Nav1.7 (Hs.PT.58.20989243), Nav1.8 (Hs.PT.58.23220090) and GUSB (Hs.PT.58v.27737538).

Results

This table below lists dual-specific compounds targeting both Nav1.7 (SCN9a) and Nav1.8 (SCN10a)

The effect is here provided as residual target RNA (normalised to GUSB) relative to PBS control.

The test was performed in regular SK-N-AS cells and in SK-N-AS following CRISPRa of Nav1.8.

| Compound | SK-N-AS SCN9a/GUSB | SK-N-AS 1.8 SCN9a/GUSB | SK-N-AS 1.8 SCN10a/GUSB |
|---|---|---|---|
| 515_3 | 0.340 | 0.423 | 1.136 |
| 526_1 | 0.238 | 0.252 | 0.851 |
| 528_1 | 0.210 | 0.236 | 0.468 |
| 631_1 | 0.086 | 0.142 | 0.496 |
| 632_1 | 0.032 | 0.054 | 0.391 |
| 636_1 | 0.021 | 0.070 | 0.286 |
| 519_6 | 0.361 | 0.490 | 0.432 |

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 50 | ATGTTTACTATAATCACA | 1037 | 1054 | 4-10-4 | 50_1 | ATGTttactataatCACA | -21 | 22.9 |
| 51 | GGCATATCATATATCC | 1779 | 1794 | 2-12-2 | 51_1 | GGcatatcatatatCC | -18 | 4.6 |
| 52 | CCAATTTTTCTTAAAATAT | 3456 | 3475 | 3-14-3 | 52_1 | CCAattttttcttaaaaTAT | -19 | 105.5 |
| 53 | TCTCATAAATCCTCATAT | 4379 | 4396 | 2-12-4 | 53_1 | TCtcataaatcctcATAT | -20 | 71.2 |
| 54 | TATTCTACCCACATTCT | 4405 | 4421 | 2-13-2 | 54_1 | TAttctacccacattCT | -20 | 64.6 |
| 55 | AGTATTCTACCCACATT | 4407 | 4423 | 2-13-2 | 55_1 | AGtattctacccacaTT | -19 | 66.8 |
| 56 | AAGTATTCTACCCACAT | 4408 | 4424 | 2-12-3 | 56_1 | AAgtattctacccaCAT | -20 | 39.5 |
| 57 | TATCTCATATTCCACAAA | 4424 | 4441 | 4-12-2 | 57_1 | TATCtcatattccacaAA | -19 | 13.4 |
| 58 | TTATCTCATATTCCACA | 4426 | 4442 | 3-12-2 | 58_1 | TTAtctcatattccaCA | -19 | 31.6 |
| 59 | GTTATCTCATATTCCAC | 4427 | 4443 | 2-12-3 | 59_1 | GTtatctcatattcCAC | -19 | 5.3 |
| 60 | TTCAATGAAGAAATTTCA | 4472 | 4489 | 4-7-7 | 60_1 | TTCAatgaagaAATTTCA | -20 | 95.3 |
| 61 | GCTCAATTTTCCAATTATT | 5276 | 5294 | 2-15-2 | 61_1 | GCtcaattttccaattaTT | -20 | 88.6 |
| 62 | TCTAATCTTATTTATCTTTC | 5302 | 5321 | 3-15-2 | 62_1 | TCTaatcttatttatctttTC | -19 | 76.4 |

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 63 | TCCCATAATATTTACCTA | 6333 | 6350 | 3-13-2 | 63_1 | TCCcataatatttaccTA | -22 | 28.6 |
| 64 | ATCACTTCAACTTTATAATA | 6386 | 6405 | 4-12-4 | 64_1 | ATCActtcaactttatAATA | -21 | 13.0 |
| 65 | TTCATCACTTCAACTTTA | 6391 | 6408 | 4-11-3 | 65_1 | TTCAtcacttcaactTTA | -20 | 11.4 |
| 66 | TCCTACCTGAATTACC | 6468 | 6483 | 2-12-2 | 66_1 | TCctacctgaattaCC | -20 | 77.2 |
| 67 | GCTTTTAACACTTTATA | 6652 | 6668 | 4-11-2 | 67_1 | GCTTttaacactttaTA | -19 | 8.2 |
| 68 | CTCCTAATATATAATATACT | 6839 | 6858 | 4-13-3 | 68_1 | CTCCtaatatataatatACT | -21 | 86.9 |
| 69 | TCTCCTAATATATAATATA | 6841 | 6859 | 4-11-4 | 69_1 | TCTCctaatatataaTATA | -21 | 86.3 |
| 70 | ATATATCTCCTAATATATA | 6846 | 6864 | 4-11-4 | 70_1 | ATATatctcctaataTATA | -21 | 99.7 |
| 71 | ACATATATCTCCTAATA | 6850 | 6868 | 4-11-4 | 71_1 | ACAtatatctcctAATA | -21 | 31.3 |
| 72 | CTCATATCTACTTATCAT | 6920 | 6937 | 4-11-3 | 72_1 | CTCAtatctacttatCAT | -22 | 9.0 |
| 73 | TACTCATATCTACTTATCA | 6921 | 6939 | 3-12-4 | 73_1 | TACtcatatctacttATCA | -22 | 36.6 |
| 74 | TCTACTCATATCTACTTA | 6924 | 6941 | 2-13-3 | 74_1 | TCtactcatatctacTTA | -19 | 85.3 |
| 75 | ACATCTACTCATATCTACT | 6926 | 6944 | 3-13-3 | 75_1 | ACAtctactcatatctACT | -21 | 48.3 |
| 76 | AATTACACCATTCCTCT | 8389 | 8405 | 3-10-4 | 76_1 | AATtacaccattcCTCT | -22 | 17.3 |
| 77 | CCCTTTTAATTACACCAT | 8395 | 8412 | 1-13-4 | 77_1 | Cccttttaattacacc CCAT | -23 | 18.7 |
| 78 | ACACTATTATACATTCCCA | 9395 | 9413 | 3-14-2 | 78_1 | ACActattatacattccCA | -22 | 83.5 |
| 79 | AGCTACACTATTATACAT | 9400 | 9417 | 3-13-2 | 79_1 | AGCtacactattatacAT | -19 | 98.7 |
| 80 | ACTTCCATATTATTTTCCAT | 9421 | 9440 | 2-15-3 | 80_1 | ACttccatattattttcCAT | -23 | 65.2 |
| 81 | TCTCCTTAAATACATCAAAT | 10395 | 10414 | 4-12-4 | 81_1 | TCTCcttaaatacatcAAAT | -21 | 68.9 |
| 82 | ATATTACTGTACTCCC | 10916 | 10931 | 1-12-3 | 82_1 | AtattactgtactCCC | -19 | 22.7 |
| 83 | ATATTTATACAACAACTCA | 12492 | 12510 | 4-11-4 | 83_1 | ATATttatacaacaaCTCA | -21 | 16.5 |
| 84 | TAGTCACCATTTTTCAT | 13016 | 13032 | 3-12-2 | 84_1 | TAGtcaccattttt cAT | -19 | 57.3 |
| 85 | AGAAAATAATTCCTATCCT | 13384 | 13402 | 2-14-3 | 85_1 | AGaaaataattcctatCCT | -20 | 108.7 |
| 86 | ATACATGTATCCACTTC | 15449 | 15465 | 1-12-4 | 86_1 | AtacatgtatccaCTTC | -18 | 21.6 |
| 87 | TTCCAATATTATTATACA | 15461 | 15478 | 4-10-4 | 87_1 | TTCCaatattattaTACA | -21 | 37.7 |
| 88 | ACCCTTATTTAAATAATTA | 15493 | 15511 | 4-11-4 | 88_1 | ACCCttatttaaataATTA | -22 | 92.5 |
| 89 | TCACGTTAAATCCCATCT | 15581 | 15598 | 2-14-2 | 89_1 | TCacgttaaatcccatCT | -21 | 27.6 |
| 90 | ACGTTAAATCCCATC | 15582 | 15596 | 4-9-2 | 90_1 | ACGTtaaatcccaTC | -18 | 28.7 |
| 91 | TTCACGTTAAATCCCA | 15584 | 15599 | 1-11-4 | 91_1 | TtcacgttaaatCCCA | -21 | 22.8 |
| 92 | GGATATCGTATTTTCT | 16909 | 16924 | 3-10-3 | 92_1 | GGAatatcgtatttTCT | -19 | 29.1 |
| 93 | TCTGGATATCGTATT | 16913 | 16927 | 5-8-2 | 93_1 | TCTGGatatcgtaTT | -19 | 98.8 |
| 94 | GATATATTATCCATCTCA | 17171 | 17188 | 4-11-3 | 94_1 | GATAtattatccatcTCA | -22 | 12.0 |
| 95 | TGATATATTATCCATCT | 17173 | 17189 | 4-9-4 | 95_1 | TGATatattatccATCT | -21 | 104.6 |
| 96 | AGCATCTACATTTTAATT | 17339 | 17356 | 4-10-4 | 96_1 | AGCAtctacattttAATT | -21 | 31.1 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 97 | TCTTAATTCTTATCATTTTA | 17606 | 17625 | 4-12-4 | 97_1 | TCTTaattcttatcatTTTA | -21 | 22.9 |
| 98 | AACTTCTTAATTCTTATCA | 17611 | 17629 | 4-11-4 | 98_1 | AACTtcttaattcttATCA | -21 | 48.8 |
| 99 | TACAATAATTATCTTCTCA | 19084 | 19102 | 4-11-4 | 99_1 | TACAataattatcttCTCA | -22 | 9.8 |
| 100 | TGCAAATAATACCCTAT | 19281 | 19297 | 3-10-4 | 100_1 | TGCaaataataccCTAT | -22 | 60.6 |
| 101 | CTCTATTCTAAATAAACCTT | 19713 | 19732 | 4-14-2 | 101_1 | CTCTattctaaataaaccTT | -20 | 69.3 |
| 102 | ACTCTATTCTAAATAAACC | 19715 | 19733 | 4-11-4 | 102_1 | ACTCtattctaaataAACC | -21 | 59.8 |
| 103 | ATGACTCTATTCTAAATA | 19719 | 19736 | 4-10-4 | 103_1 | ATGActctattctaAATA | -20 | 70.5 |
| 104 | TAAGCATATATTTTCCCA | 20666 | 20683 | 1-14-3 | 104_1 | TaagcatatattttcCCA | -20 | 41.0 |
| 105 | TCATTTCCATTAAATCCAA | 21212 | 21230 | 4-12-3 | 105_1 | TCATttccattaaatcCAA | -22 | 19.0 |
| 106 | TTTCATTTCCATTAAATCC | 21214 | 21232 | 4-12-3 | 106_1 | TTTCatttccattaaaTCC | -22 | 8.8 |
| 107 | TTTTATCCTACTTCTAC | 22208 | 22224 | 1-12-4 | 107_1 | TtttatcctacttCTAC | -18 | 94.6 |
| 108 | TCCCTCAAATATAAATTC | 22299 | 22316 | 4-11-3 | 108_1 | TCCCtcaaatataaaTTC | -21 | 86.8 |
| 109 | ACTGTTTCTCTAAACC | 23036 | 23052 | 2-11-4 | 109_1 | ACtgttttctctaAACC | -20 | 24.9 |
| 110 | AGATTCACTACATCCA | 24286 | 24301 | 3-10-3 | 110_1 | AGAttcactacatCCA | -22 | 10.8 |
| 111 | GCACTCTGATTACATTTCCT | 24422 | 24441 | 1-17-2 | 111_1 | GcactctgattacatttcCT | -23 | 62.0 |
| 112 | TATTTAATCACTTTATCTAA | 24503 | 24522 | 2-14-4 | 112_1 | TAtttaatcactttatCTAA | -18 | 102.4 |
| 113 | ATATTTAATCACTTTATCT | 24505 | 24523 | 2-13-4 | 113_1 | ATatttaatcactttATCT | -18 | 125.6 |
| 114 | ATCAACCACACAATTACTTT | 24715 | 24734 | 1-15-4 | 114_1 | AtcaaccacacaattaCTTT | -20 | 72.4 |
| 115 | TATCAACCACACAATTACTT | 24716 | 24735 | 2-15-3 | 115_1 | TAtcaaccacacaattaCTT | -21 | 88.8 |
| 116 | TTATCAACCACACAATTAC | 24718 | 24736 | 3-13-3 | 116_1 | TTAtcaaccacacaatTAC | -19 | 81.8 |
| 117 | TCAATAAAATTCCTTATACT | 25826 | 25845 | 2-14-4 | 117_1 | TCaataaaattccttaTACT | -19 | 99.6 |
| 118 | TCATTTTATTTATTTCAATT | 26537 | 26556 | 4-12-4 | 118_1 | TCATtttatttatttcAATT | -19 | 86.7 |
| 119 | TATACACTCTTTCTCTATTC | 26697 | 26716 | 2-14-4 | 119_1 | TAtacactctttctctATTC | -22 | 94.0 |
| 120 | TGACCATCTTATTCATC | 26782 | 26798 | 4-10-3 | 120_1 | TGAccatcttattcATC | -21 | 43.6 |
| 121 | CCTGATACTCATTCCCA | 27287 | 27303 | 1-14-2 | 121_1 | CctgatactcattccCA | -21 | 57.2 |
| 122 | TTTCTCTTATCTTTTATC | 27498 | 27516 | 4-12-3 | 122_1 | TTTCtcttatcttttATC | -20 | 30.1 |
| 123 | AAATCAACCCTAAACCC | 27530 | 27546 | 3-10-4 | 123_1 | AAAtcaaccctaaACCC | -22 | 105.9 |
| 124 | AAAGTACCATTTACTCCC | 27603 | 27620 | 4-12-2 | 124_1 | AAAGtaccatttactcCC | -23 | 9.1 |
| 125 | TTCATATACTCTTATTTTA | 27669 | 27687 | 4-11-4 | 125_1 | TTCatatactcttatTTTA | -20 | 10.5 |
| 126 | CTAATTTTCATATACTCTT | 27675 | 27694 | 1-15-4 | 126_1 | CtaattttcatatacTCTT | -19 | 100.5 |
| 127 | TCTAATTTTCATATACTC | 27677 | 27695 | 4-11-4 | 127_1 | TCTAattttcatatACTC | -21 | 7.0 |
| 128 | CTCTAATTTTCATATACT | 27678 | 27696 | 3-12-4 | 128_1 | CTCtaattttcataTACT | -21 | 57.2 |
| 129 | ACATTTTCCTACAAACTA | 27781 | 27799 | 3-12-4 | 129_1 | ACAttttcctacaaACTA | -22 | 115.4 |
| 130 | CTACTATTCCATCATTTTT | 28331 | 28349 | 4-13-2 | 130_1 | CTACtattccatcatttTT | -22 | 17.3 |
| 131 | CAATTACACCTACAACTTC | 28710 | 28728 | 2-13-4 | 131_1 | CAattacacctacaaCTTC | -21 | 55.7 |

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 132 | TCCAATTACACCTACAAC | 28713 | 28730 | 3-11-4 | 132_1 | TCCaattacacctaCAAC | -23 | 16.5 |
| 133 | GCCTTAATCAATTTCTCAA | 29790 | 29808 | 3-14-2 | 133_1 | GCCttaatcaatttctcAA | -22 | 78.6 |
| 134 | CACTTTCCAATATTACT | 30079 | 30095 | 3-11-3 | 134_1 | CACtttccaatattACT | -19 | 32.1 |
| 135 | TTACACTTTCCAATATTAC | 30080 | 30098 | 4-11-4 | 135_1 | TTACactttccaataTTAC | -22 | 18.0 |
| 136 | CATTACACTTTCCAATATTA | 30081 | 30100 | 4-13-3 | 136_1 | CATTacactttccaataTTA | -23 | 14.3 |
| 137 | ACATTACACTTTCCAATA | 30084 | 30101 | 4-10-4 | 137_1 | ACATtacactttccAATA | -21 | 31.4 |
| 138 | ATATACCCCAATTACTCCA | 30949 | 30967 | 1-16-2 | 138_1 | AtataccccaattactcCA | -22 | 77.5 |
| 139 | ATACTAGCAATTCATCA | 31411 | 31427 | 4-9-4 | 139_1 | ATACtagcaattcATCA | -21 | 58.4 |
| 140 | ATACCATTAACTATCACC | 31626 | 31643 | 2-12-4 | 140_1 | ATaccattaactatCACC | -22 | 32.4 |
| 141 | AGATACCATTAACTATCA | 31628 | 31645 | 4-11-3 | 141_1 | AGATaccattaactaTCA | -22 | 81.6 |
| 142 | CCCATCTTCATTATATTA | 32138 | 32155 | 2-12-4 | 142_1 | CCcatcttcattatATTA | -22 | 94.9 |
| 143 | TTCTGATCTCTCTTATA | 34051 | 34067 | 1-12-4 | 143_1 | TtctgatctctctTATA | -18 | 76.2 |
| 144 | ATTTCATTCAGGAAATAC | 34107 | 34124 | 1-10-7 | 144_1 | AtttcattcagGAAATAC | -19 | 95.0 |
| 145 | TCATTTCATCAATAACATTA | 34132 | 34151 | 3-15-2 | 145_1 | TCAtttcatcaataacatTA | -18 | 83.0 |
| 146 | TTGCTTTTTTACTAACA | 34181 | 34197 | 4-11-2 | 146_1 | TTGCttttttactaaCA | -20 | 45.3 |
| 147 | GTTTCATTTCTTTATTAT | 34206 | 34223 | 2-12-4 | 147_1 | GTttcatttctttaTTAT | -19 | 78.5 |
| 148 | GCTATTATATTACTTTT | 34269 | 34285 | 4-9-4 | 148_1 | GCTAttatattacTTTT | -20 | 23.6 |
| 149 | GTCCTCTAATCATATCACA | 35539 | 35557 | 1-15-3 | 149_1 | GtcctctaatcatatcACA | -21 | 71.5 |
| 150 | TAGTCCTCTAATCATATC | 35542 | 35559 | 2-12-4 | 150_1 | TAgtcctctaatcaTATC | -21 | 46.3 |
| 151 | TTAGTCCTCTAATCATA | 35544 | 35560 | 4-10-3 | 151_1 | TTAGtcctctaatcATA | -21 | 55.1 |
| 152 | ACTTAGTCCTCTAATCA | 35546 | 35562 | 4-11-2 | 152_1 | ACTTagtcctctaatCA | -21 | 27.0 |
| 153 | TAAATAAACAATCCCCA | 36850 | 36867 | 2-12-4 | 153_1 | TAaataaacaatcCCCA | -21 | 73.2 |
| 154 | TAATTAAATAAACAATCCC | 36852 | 36871 | 2-14-4 | 154_1 | TAattaaataaacaaTCCC | -18 | 94.5 |
| 155 | ATACATACCTCTATTATT | 38088 | 38105 | 4-10-4 | 155_1 | ATACatacctctatTATT | -21 | 47.1 |
| 156 | TCAATACATACCTCTATTA | 38090 | 38108 | 4-11-4 | 156_1 | TCAAtacatacctctATTA | -22 | 30.7 |
| 157 | CTCAATACATACCTCTATT | 38091 | 38109 | 1-14-4 | 157_1 | CtcaatacatacctcTATT | -20 | 100.7 |
| 158 | GAACTCAATACATACCTC | 38095 | 38112 | 4-11-3 | 158_1 | GAACtcaatacatacCTC | -21 | 14.4 |
| 159 | AGAACTCAATACATACC | 38097 | 38113 | 2-11-4 | 159_1 | AGaactcaatacaTACC | -19 | 15.4 |
| 160 | TGAATTTTATTCCCTTC | 42260 | 42277 | 2-13-3 | 160_1 | TGaattttattcccTTC | -19 | 59.5 |
| 161 | ACACAATACCATATTTCA | 42376 | 42393 | 4-10-4 | 161_1 | ACACaataccatatTTCA | -22 | 7.5 |
| 162 | TGCTATAATATTTATCT | 42912 | 42929 | 4-10-4 | 162_1 | TGCTataatattttATCT | -22 | 65.7 |
| 163 | ACAACTTTCAATACTCTA | 43082 | 43100 | 4-11-4 | 163_1 | ACAacttcaatacTCTA | -21 | 9.6 |
| 164 | TCTTCTACACTATTATTC | 43218 | 43235 | 2-12-4 | 164_1 | TCttctacactattATTC | -19 | 60.1 |
| 165 | ATATCTTCTACACTATTATT | 43219 | 43238 | 3-13-4 | 165_1 | ATAtcttctacactatTATT | -21 | 97.4 |

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 166 | TATATCTTCTACACTATTA | 43221 | 43239 | 4-11-4 | 166_1 | TATAtcttctacactATTA | -21 | 93.3 |
| 167 | TTATATCTTCTACACTA | 43224 | 43240 | 3-10-4 | 167_1 | TTAtatcttctacACTA | -19 | 81.7 |
| 168 | AGCTCATTTTCCTATAC | 43713 | 43729 | 3-12-2 | 168_1 | AGCtcattttcctatAC | -21 | 67.8 |
| 169 | TACTTTTTTTCTATCCAA | 44082 | 44100 | 4-12-3 | 169_1 | TACTttttttctatcCAA | -22 | 59.2 |
| 170 | TCTACTTTTTTTCTATC | 44085 | 44102 | 2-12-4 | 170_1 | TCtactttttttcTATC | -20 | 72.4 |
| 171 | TTTATTAATTTACTCCTT | 44846 | 44863 | 4-10-4 | 171_1 | TTTAttaatttactCCTT | -21 | 41.8 |
| 172 | ATTTTATTAATTTACTCC | 44848 | 44865 | 4-10-4 | 172_1 | ATTTtattaatttaCTCC | -20 | 42.1 |
| 173 | ACCAATACCATAAATTCCA | 44868 | 44886 | 2-14-3 | 173_1 | ACcaataccataaattCCA | -22 | 35.9 |
| 174 | ATTAATATTTTTCTCCAT | 45728 | 45746 | 3-12-4 | 174_1 | ATTaatatttttctCCAT | -22 | 70.9 |
| 175 | TTTATTAATATTTTTCTCC | 45730 | 45749 | 3-13-4 | 175_1 | TTTattaatatttttCTCC | -22 | 39.4 |
| 176 | TCCTTTTATTAATATTTTT | 45734 | 45753 | 4-14-2 | 176_1 | TCCTtttattaatattttTT | -20 | 92.9 |
| 177 | CCTCCTTTTATTAATATT | 45738 | 45755 | 4-11-3 | 177_1 | CCTCcttttattaatATT | -22 | 94.9 |
| 178 | GCCTCCTTTTATTAATAT | 45739 | 45756 | 2-13-3 | 178_1 | GCctccttttattaaTAT | -22 | 55.4 |
| 179 | TAACATATCTACCATCTC | 46470 | 46487 | 3-11-4 | 179_1 | TAAcatatctaccaTCTC | -21 | 24.1 |
| 180 | AATCCCTTACCATTATT | 47155 | 47171 | 4-10-3 | 180_1 | AATCccttaccattATT | -21 | 48.5 |
| 181 | ACAGCTTCATTTAACTA | 48015 | 48031 | 4-10-3 | 181_1 | ACAGcttcatttaaCTA | -21 | 61.0 |
| 182 | TTAACCAAATCTATACACT | 48381 | 48399 | 4-11-4 | 182_1 | TTAAccaaatctataCACT | -21 | 49.8 |
| 183 | TTAGACTAACCATCCTA | 49270 | 49286 | 3-11-3 | 183_1 | TTAgactaaccatcCTA | -21 | 64.0 |
| 184 | TATTAGACTAACCATCC | 49272 | 49288 | 4-10-3 | 184_1 | TATTagactaaccaTCC | -22 | 47.9 |
| 185 | ACCTCATAATACTTTTC | 49305 | 49321 | 3-10-4 | 185_1 | ACCtcataatactTTTC | -20 | 58.1 |
| 186 | TACCTGATAACATCTTT | 49578 | 49594 | 4-9-4 | 186_1 | TACCtgataacatCTTT | -22 | 18.9 |
| 187 | TTACTAATCTAAATACCT | 49590 | 49607 | 4-10-4 | 187_1 | TTACtaatctaaatACCT | -20 | 90.4 |
| 188 | TCTCATTTTACTAATCTA | 49597 | 49614 | 4-11-3 | 188_1 | TCTCattttactaatCTA | -21 | 38.0 |
| 189 | TTCTCATTTTACTAATCT | 49598 | 49615 | 3-12-3 | 189_1 | TTCtcattttactaaTCT | -19 | 87.2 |
| 190 | AACCAAGTCTATATCCA | 49655 | 49671 | 3-10-4 | 190_1 | AACcaagtctataTCCA | -22 | 37.6 |
| 191 | TCACCTTCATAACTTATC | 50050 | 50067 | 4-11-3 | 191_1 | TCACcttcataacttATC | -21 | 69.9 |
| 192 | ATTTTAAATTACTCTCCTAT | 50079 | 50098 | 4-13-3 | 192_1 | ATTTtaaattactctccTAT | -21 | 93.0 |
| 193 | ATATTTTAAATTACTCTCCT | 50081 | 50100 | 3-14-3 | 193_1 | ATAttttaaattactctCCT | -22 | 101.6 |
| 194 | AGTACAATTTAACTCCCT | 50396 | 50413 | 1-14-3 | 194_1 | AgtacaatttaactcCCT | -21 | 93.8 |
| 195 | ATTATCTATAATATACCTA | 50755 | 50773 | 4-11-4 | 195_1 | ATTAtctataatataCCTA | -22 | 102.1 |
| 196 | TCCATAAATCTATTCCAA | 50889 | 50906 | 4-11-3 | 196_1 | TCCAtaaatctattcCAA | -22 | 34.6 |
| 197 | TTCCATAAATCTATTCCA | 50890 | 50907 | 3-12-3 | 197_1 | TTCcataaatctattCCA | -22 | 16.2 |
| 198 | TTTCCATAAATCTATTCC | 50891 | 50908 | 4-10-4 | 198_1 | TTTCcataaatctaTTCC | -22 | 70.6 |
| 199 | AGCAAATAAATTCCAACAC | 52815 | 52833 | 4-12-3 | 199_1 | AGCAaataaattccaaCAC | -22 | 28.9 |
| 200 | TCATGCTTCCATAATTA | 53336 | 53352 | 2-11-4 | 200_1 | TCatgcttccataATTA | -19 | 21.2 |

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 201 | CCTTTCCCATTACAATTT | 53599 | 53616 | 1-13-4 | 201_1 | CctttcccattacaATTT | -21 | 63.4 |
| 202 | ACATGATACTTAATACC | 55294 | 55310 | 4-9-4 | 202_1 | ACATgatacttaaTACC | -21 | 97.9 |
| 203 | CAACAATATCAATCTTCC | 55360 | 55377 | 4-10-4 | 203_1 | CAAcaatatcaatcTTCC | -21 | 41.4 |
| 204 | TTATTAATATTTCTTCTTCA | 55509 | 55528 | 3-14-3 | 204_1 | TTAttaatatttcttctTCA | -19 | 82.5 |
| 205 | TCAGTTAATCATCTCAC | 56328 | 56344 | 4-10-3 | 205_1 | TCAGttaatcatctCAC | -21 | 29.8 |
| 206 | TTGCCATTAAAATTTCC | 56848 | 56864 | 2-11-4 | 206_1 | TTgccattaaaatTTCC | -19 | 39.2 |
| 207 | GATGAACAGACCAAACT | 57524 | 57540 | 2-9-6 | 207_1 | GAtgaacagacCAAACT | -20 | 50.9 |
| 208 | ATCCATACATCCTAAAAT | 57753 | 57770 | 4-10-4 | 208_1 | ATCCatacatcctaAAAT | -21 | 83.7 |
| 209 | CTCATCCATACATCCTA | 57757 | 57773 | 1-13-3 | 209_1 | CtcatccatacatCCTA | -21 | 91.9 |
| 210 | GTCCAAATATCATATCAT | 58334 | 58351 | 4-11-3 | 210_1 | GTCCaaatatcatatCAT | -22 | 92.5 |
| 211 | TGTCCAAATATCATATC | 58336 | 58352 | 4-9-4 | 211_1 | TGTCcaaatatcaTATC | -21 | 114.5 |
| 212 | ACCATTAATCTCATATT | 58538 | 58554 | 4-9-4 | 212_1 | ACCAttaatctcaTATT | -21 | 61.8 |
| 213 | TCACCATTAATCTCATAT | 58539 | 58556 | 4-11-3 | 213_1 | TCACcattaatctcaTAT | -22 | 78.6 |
| 214 | CACCATTAATCTCATA | 58540 | 58555 | 2-10-4 | 214_1 | CAccattaatctCATA | -19 | 65.7 |
| 215 | ATCAATCAATATTTATTCTT | 58702 | 58721 | 3-14-3 | 215_1 | ATCaatcaatatttattCTT | -18 | 111.2 |
| 216 | ATACTTTACTTTTCAAATTT | 58822 | 58841 | 4-14-2 | 216_1 | ATACtttacttttcaaatTT | -18 | 86.5 |
| 217 | TATACTTTACTTTTCAAATT | 58823 | 58842 | 4-14-2 | 217_1 | TATActttacttttcaaaTT | -18 | 106.2 |
| 218 | CTTTATACTTTACTTTTCAA | 58826 | 58845 | 2-14-4 | 218_1 | CTttatactttacttttTCAA | -20 | 49.3 |
| 219 | TCTTTATACTTTACTTTTCA | 58827 | 58846 | 2-16-2 | 219_1 | TCtttatactttacttttCA | -19 | 105.0 |
| 220 | CCAATATTCCTATTCTC | 60635 | 60651 | 2-12-3 | 220_1 | CCaatattcctattCTC | -21 | 75.8 |
| 221 | TGTAACCACTCTTATCAAT | 62608 | 62626 | 2-13-4 | 221_1 | TGtaaccactcttatCAAT | -21 | 92.3 |
| 222 | AATGTAACCACTCTTATC | 62611 | 62628 | 2-12-4 | 222_1 | AAtgtaaccactctTATC | -19 | 40.3 |
| 223 | TTCCAATTTCCTATTAAT | 63501 | 63518 | 4-10-4 | 223_1 | TTCCaatttcctatTAAT | -22 | 100.2 |
| 224 | CATTCCAATTTCCTATTA | 63503 | 63520 | 3-12-3 | 224_1 | CATtccaatttcctaTTA | -21 | 121.2 |
| 225 | AAATTTTCCTAAATTCCCC | 63916 | 63934 | 1-15-3 | 225_1 | AaattttcctaaattcCCC | -22 | 90.1 |
| 226 | TTCACTAATCTCAATTTA | 64566 | 64583 | 4-10-4 | 226_1 | TTCActaatctcaaTTTA | -19 | 31.2 |
| 227 | ACTAAATTTCACTAATCTCA | 64571 | 64590 | 1-15-4 | 227_1 | ActaaatttcactaatCTCA | -19 | 62.4 |
| 228 | TTATTCACTAAATTTCACT | 64578 | 64596 | 4-11-4 | 228_1 | TTATtcactaaatttCACT | -21 | 89.1 |
| 229 | TGCTAAACAATTATACTA | 66548 | 66565 | 4-12-2 | 229_1 | TGCTaaacaattatacTA | -19 | 96.5 |
| 230 | AATTATTCATCCATTCTTTC | 67741 | 67760 | 1-15-4 | 230_1 | AattattcatccattcTTTC | -20 | 32.5 |
| 231 | ATCAATTTTCACATCAATA | 68866 | 68885 | 4-12-4 | 231_1 | ATCAattttcacatcAATA | -21 | 51.1 |
| 232 | TTATACCCACTTACTC | 69491 | 69506 | 3-11-2 | 232_1 | TTAtacccacttacTC | -18 | 102.6 |
| 233 | GTACTTATACCCACTTAC | 69493 | 69510 | 1-14-3 | 233_1 | GtacttatacccactTAC | -20 | 101.0 |
| 234 | ATGTACTTATACCCACTT | 69495 | 69512 | 1-14-3 | 234_1 | AtgtacttatacccaCTT | -20 | 95.9 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 235 | TGTACTTATACCCACT | 69496 | 69511 | 2-12-2 | 235_1 | TGtacttatacccaCT | -19 | 98.5 |
| 236 | AAATGTACTTATACCCAC | 69497 | 69514 | 1-13-4 | 236_1 | AaatgtacttatacCCAC | -20 | 93.0 |
| 237 | CATCTAATTTTTCTAATCT | 69660 | 69678 | 4-11-4 | 237_1 | CATCtaattttctaATCT | -22 | 58.2 |
| 238 | TTATAAACATACACCCA | 69755 | 69772 | 3-11-4 | 238_1 | TTAtaaacatacaCCCA | -22 | 74.9 |
| 239 | ATTATAAACATACACCC | 69756 | 69773 | 4-10-4 | 239_1 | ATTAtaaacatacACCC | -21 | 39.1 |
| 240 | CTTCTATCAAAAATTCACC | 69800 | 69818 | 4-12-3 | 240_1 | CTTCtatcaaaaattcACC | -21 | 51.1 |
| 241 | CAAAGTATATATTCCA | 70094 | 70110 | 3-8-6 | 241_1 | CAAagtatatATTCCA | -20 | 22.6 |
| 242 | TACGCAAAAACAATGAC | 70197 | 70213 | 4-7-6 | 242_1 | TACGcaaaaacAATGAC | -20 | 65.7 |
| 243 | TTACGCAAAAACAATG | 70199 | 70214 | 5-5-6 | 243_1 | TTACGcaaaaACAATG | -19 | 111.1 |
| 244 | TACTTACGCAAAAACA | 70202 | 70217 | 5-8-3 | 244_1 | TACTTacgcaaaaACA | -18 | 99.6 |
| 245 | CAGCTCTTTTACAAATAT | 70637 | 70654 | 4-12-2 | 245_1 | CAGCtcttttacaaatAT | -21 | 48.5 |
| 246 | TCTATGATACTTACCT | 71617 | 71632 | 2-10-4 | 246_1 | TCtatgatacttACCT | -19 | 96.9 |
| 247 | ACACCAATTACTTCTTACC | 71764 | 71782 | 1-16-2 | 247_1 | AcaccaattacttcttaCC | -20 | 101.9 |
| 248 | CACACCAATTACTTCTTAC | 71765 | 71783 | 1-15-3 | 248_1 | CacaccaattacttctTAC | -19 | 98.1 |
| 249 | TTCACACCAATTACTTCTTA | 71766 | 71785 | 1-17-2 | 249_1 | TtcacaccaattacttctTA | -19 | 115.8 |
| 250 | GCTTCACACCAATTACTTC | 71769 | 71787 | 1-16-2 | 250_1 | GcttcacaccaattactTC | -20 | 63.0 |
| 251 | CCTAATGCTTCACACC | 71778 | 71793 | 1-12-3 | 251_1 | CctaatgcttcacACC | -20 | 24.0 |
| 252 | ACAACTCCCAAATAGTT | 71808 | 71824 | 4-10-3 | 252_1 | ACAActcccaaataGTT | -21 | 96.1 |
| 253 | AAATTTAATTAAAATTGC | 72045 | 72062 | 6-5-7 | 253_1 | AAATTTaattaAAATTGC | -18 | 112.6 |
| 254 | ATGCATTATATCAAATCA | 72601 | 72618 | 4-10-4 | 254_1 | ATGCattatatcaaATCA | -22 | 92.9 |
| 255 | AAAACACAAGCTTTCCTA | 72626 | 72643 | 6-9-3 | 255_1 | AAAACacaagctttcCTA | -22 | 41.2 |
| 256 | TCATCCAATATTCATCA | 73726 | 73742 | 3-11-3 | 256_1 | TCAtccaatattcaTCA | -20 | 21.9 |
| 257 | ATATTACTTTTTATTATCTA | 73925 | 73944 | 4-12-4 | 257_1 | ATATtacttttattaTCTA | -21 | 37.0 |
| 258 | GCTAAATTCCTCATCAAAT | 74127 | 74145 | 2-15-2 | 258_1 | GCtaaattcctcatcaaAT | -20 | 79.8 |
| 259 | TGCTAAATTCCTCATCAAA | 74128 | 74146 | 3-13-3 | 259_1 | TGCtaaattcctcatcAAA | -21 | 70.9 |
| 260 | ATATGCTAAATTCCTCATCA | 74130 | 74149 | 1-17-2 | 260_1 | AtatgctaaattcctcatCA | -19 | 95.2 |
| 261 | ATGCTAAATTCCTCATC | 74131 | 74147 | 3-10-4 | 261_1 | ATGctaaattcctCATC | -22 | 56.8 |
| 262 | TATGCTAAATTCCTCAT | 74132 | 74148 | 2-12-3 | 262_1 | TAtgctaaattcctCAT | -18 | 72.9 |
| 263 | GAAAATATGCTAAATTCCT | 74135 | 74153 | 3-10-6 | 263_1 | GAAaatatgctaaATTCCT | -22 | 85.3 |
| 264 | TGCAATCTAACTTCATA | 74761 | 74777 | 3-12-2 | 264_1 | TGCaatctaacttcaTA | -18 | 58.0 |
| 265 | CTTGATTTAAACACCTCT | 75260 | 75277 | 2-13-3 | 265_1 | CTtgatttaaacaccTCT | -20 | 20.9 |
| 266 | ACTTGATTTAAACACCT | 75262 | 75278 | 2-12-3 | 266_1 | ACttgatttaaacaCCT | -18 | 36.6 |
| 267 | GCTTCTTACTATCTTTTA | 75590 | 75607 | 3-13-2 | 267_1 | GCTtcttactatctttTA | -21 | 47.6 |
| 268 | GTCTTCTTTAATCCATCA | 76043 | 76060 | 1-13-4 | 268_1 | GtcttcttaatccATCA | -21 | 29.5 |
| 269 | CTATATTATATATCCACCT | 76205 | 76223 | 2-15-2 | 269_1 | CTatattatatatccacCT | -20 | 97.7 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 270 | CTCTATATTATATATCCAC | 76207 | 76225 | 3-13-3 | 270_1 | CTCtatattatatatcCAC | -20 | 25.7 |
| 271 | TCTCTATATTATATATCCA | 76208 | 76226 | 2-14-3 | 271_1 | TCtctatattatatatCCA | -20 | 53.9 |
| 272 | ATTCTCTATATTATATATCC | 76209 | 76228 | 2-15-3 | 272_1 | ATtctctatattatataTCC | -20 | 92.3 |
| 273 | CCAATTCTCTATATTATAT | 76213 | 76231 | 2-14-3 | 273_1 | CCaattctctatattaTAT | -19 | 88.5 |
| 274 | TCCAATTCTCTATATTATA | 76214 | 76232 | 3-13-3 | 274_1 | TCCaattctctatattATA | -21 | 30.0 |
| 275 | TCTCCAATTCTCTATATTAT | 76215 | 76234 | 2-15-3 | 275_1 | TCtccaattctctatatTAT | -21 | 62.8 |
| 276 | ATCTCCAATTCTCTATATTA | 76216 | 76235 | 1-15-4 | 276_1 | AtctccaattctctatATTA | -20 | 98.1 |
| 277 | AATCTCCAATTCTCTATATT | 76217 | 76236 | 2-14-4 | 277_1 | AAtctccaattctctaTATT | -21 | 93.8 |
| 278 | TAAATCTCCAATTCTCTATA | 76219 | 76238 | 2-16-2 | 278_1 | TAaatctccaattctctaTA | -19 | 100.0 |
| 279 | GAATTTATCTCCAAACTCA | 76262 | 76280 | 3-12-4 | 279_1 | GAAtttatctccaaaCTCA | -22 | 47.5 |
| 280 | TGTCTACACATATTACC | 76709 | 76725 | 2-11-4 | 280_1 | TGtctacacatatTACC | -21 | 31.7 |
| 281 | TGATCCCATCTTATAC | 77011 | 77026 | 3-11-2 | 281_1 | TGAcccatcttatAC | -18 | 21.9 |
| 282 | TATATTTCTCCATAATAC | 77663 | 77680 | 3-12-3 | 282_1 | TATatttctccataaTAC | -18 | 36.3 |
| 283 | TATTCCTCAATAAACCTA | 78216 | 78233 | 2-12-4 | 283_1 | TAttcctcaataaaCCTA | -21 | 61.6 |
| 284 | GACTTCCTATTTTACTCA | 79981 | 79998 | 2-14-2 | 284_1 | GActtcctattttactCA | -20 | 82.6 |
| 285 | TTTCTCATATATTCTCCC | 81181 | 81198 | 1-15-2 | 285_1 | TttctcatatattctcCC | -20 | 81.7 |
| 286 | TTTTCTCATATATTCTCC | 81182 | 81199 | 3-12-3 | 286_1 | TTTtctcatatattcTCC | -21 | 22.6 |
| 287 | CTATTTTCTCATATATTCT | 81184 | 81202 | 4-12-3 | 287_1 | CTATtttctcatatatTCT | -22 | 31.1 |
| 288 | TTTACTATTTTCTCATATAT | 81187 | 81206 | 4-12-4 | 288_1 | TTTActattttctcatATAT | -21 | 21.4 |
| 289 | TTACTATTTTCTCATATA | 81188 | 81205 | 4-10-4 | 289_1 | TTACtattttctcaTATA | -21 | 22.1 |
| 290 | AACAAATATTACATACCCT | 81401 | 81419 | 3-12-4 | 290_1 | AACaaatattacataCCCT | -22 | 93.8 |
| 291 | TGCCATTAAATAAATACA | 82068 | 82085 | 4-10-4 | 291_1 | TGCCattaaataaaTACA | -22 | 87.4 |
| 292 | TGCCATTCAAAAATACAAT | 82794 | 82812 | 3-12-4 | 292_1 | TGCcattcaaaaataCAAT | -21 | 76.6 |
| 293 | TAATATACTTTATCATACA | 83724 | 83743 | 2-14-4 | 293_1 | TAatatactttatcaTACA | -18 | 80.4 |
| 294 | ATTACTTTATTCATCTCAT | 86909 | 86927 | 2-14-3 | 294_1 | ATtactttattcatctCAT | -19 | 87.1 |
| 295 | TAATTACTTTATTCATCTCA | 86910 | 86929 | 3-14-3 | 295_1 | TAAttactttattcatcTCA | -20 | 49.2 |
| 296 | TTAATTACTTTATTCATCTC | 86911 | 86930 | 2-15-3 | 296_1 | TTaattactttattcatCTC | -18 | 60.0 |
| 297 | TTTAATTACTTTATTCATCT | 86912 | 86931 | 4-14-2 | 297_1 | TTTAattactttattcatCT | -19 | 87.2 |
| 298 | ATTTAATTACTTTATTCATC | 86913 | 86932 | 2-14-4 | 298_1 | ATttaattactttattCATC | -18 | 101.8 |
| 299 | TTCTATCTTTTCTTTCTTTA | 86984 | 87003 | 1-15-4 | 299_1 | TtctatcttttctttcTTTA | -20 | 107.9 |
| 300 | CATGCATTTTTCCTACA | 87092 | 87109 | 3-13-2 | 300_1 | CATgcatttttcctaCA | -22 | 50.4 |
| 301 | GAAATTCTAATTCTTTCT | 87504 | 87521 | 4-10-4 | 301_1 | GAAAttctaattctTTCT | -18 | 90.2 |
| 302 | AACATCTGTTGAAATTCT | 87514 | 87531 | 2-10-6 | 302_1 | AAcatctgttgaAATTCT | -19 | 29.8 |
| 303 | ATTTAATCCATCATTATTCT | 88639 | 88658 | 2-14-4 | 303_1 | ATttaatccatcattaTTCT | -21 | 74.3 |

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 304 | TAACTCCATATCATCAATA | 89002 | 89020 | 4-11-4 | 304_1 | TAACtccatatcatcAATA | -21 | 57.7 |
| 305 | ATTAACTCCATATCATCAA | 89004 | 89022 | 4-11-4 | 305_1 | ATTAactccatatcaTCAA | -22 | 42.2 |
| 306 | AATTAACTCCATATCATCA | 89005 | 89023 | 4-11-4 | 306_1 | AATTaactccatatcATCA | -22 | 46.8 |
| 307 | TTTACCTAAAATCATACCA | 89772 | 89790 | 2-13-4 | 307_1 | TTtacctaaaatcatACCA | -20 | 61.4 |
| 308 | TTATATATCAATCCCCA | 90811 | 90827 | 3-11-3 | 308_1 | TTAtatatcaatccCCA | -22 | 78.2 |
| 309 | TTTTATATATCAATCCCC | 90812 | 90829 | 3-13-2 | 309_1 | TTTtatatatcaatccCC | -20 | 56.1 |
| 310 | TTTTTATATATCAATCCC | 90813 | 90830 | 4-10-4 | 310_1 | TTTTtatatatcaaTCCC | -22 | 32.6 |
| 311 | CTAAAAGACTTGTTCT | 91226 | 91242 | 4-8-5 | 311_1 | CTAAaaagacttGTTCT | -20 | 26.3 |
| 312 | ACTAAAAGACTTGTTC | 91227 | 91243 | 5-8-4 | 312_1 | ACTAAaaagacttGTTC | -18 | 31.0 |
| 313 | CCTTATCTATTATCACC | 91516 | 91532 | 3-12-2 | 313_1 | CCTtatctattatcaCC | -22 | 88.1 |
| 314 | GCCTTATCTATTATCAC | 91517 | 91533 | 3-12-2 | 314_1 | GCCttatctattatcAC | -21 | 97.4 |
| 315 | TTGCCTTATCTATTATC | 91519 | 91535 | 1-12-4 | 315_1 | TtgccttatctatTATC | -18 | 82.9 |
| 316 | TCCTTACGCTGTCATCA | 91540 | 91556 | 2-13-2 | 316_1 | TCcttacgctgtcatCA | -22 | 46.4 |
| 317 | TAATCCAAATTTCTTCATA | 91902 | 91920 | 3-12-4 | 317_1 | TAAtccaaatttcttCATA | -20 | 34.9 |
| 318 | CTTTCAAGCCTAATCA | 92437 | 92452 | 1-11-4 | 318_1 | CtttcaagcctaATCA | -19 | 77.5 |
| 319 | TGTTTTCATATAAACCAT | 93022 | 93039 | 2-12-4 | 319_1 | TGttttcatataaaCCAT | -20 | 67.3 |
| 320 | GATTATTACATACCTTCCA | 94318 | 94336 | 1-15-3 | 320_1 | GattattacataccttCCA | -22 | 86.0 |
| 321 | TATCTTTACCATCATTTAA | 94440 | 94458 | 4-11-4 | 321_1 | TATCtttaccatcatTTAA | -22 | 42.1 |
| 322 | GTTATCTTTACCATCATT | 94443 | 94460 | 3-11-4 | 322_1 | GTTatctttaccatCATT | -23 | 23.0 |
| 323 | AGACTTACCAAATTTCC | 95637 | 95653 | 4-11-2 | 323_1 | AGACttaccaaatttCC | -21 | 90.7 |
| 324 | GAACATGTTGACTCAC | 97243 | 97258 | 4-8-4 | 324_1 | GAACatgttgacTCAC | -20 | 61.8 |
| 325 | AGTTTTAATACCATTTCA | 97712 | 97729 | 3-13-2 | 325_1 | AGTtttaataccatttCA | -19 | 20.1 |
| 326 | CAGTTTTAATACCATTTC | 97713 | 97730 | 4-12-2 | 326_1 | CAGTtttaataccattTC | -20 | 72.1 |
| 327 | ATAATTTATCCTTAATTCT | 98353 | 98371 | 3-13-3 | 327_1 | ATAatttatccttaatTCT | -19 | 65.3 |
| 328 | TCAATGTTTCCAATCTT | 98600 | 98616 | 2-12-3 | 328_1 | TCaatgtttccaatCTT | -18 | 42.4 |
| 329 | CATCTGGTTACATACCACC | 99016 | 99034 | 1-16-2 | 329_1 | CatctggttacataccaCC | -23 | 74.8 |
| 330 | ATCACAAAATAATTTCCAC | 99056 | 99074 | 2-13-4 | 330_1 | ATcacaaaataatttCCAC | -19 | 35.3 |
| 331 | CATCACAAAATAATTTCCA | 99057 | 99075 | 2-14-3 | 331_1 | CAtcacaaaataatttCCA | -19 | 74.3 |
| 332 | TCATCACAAAATAATTTCC | 99058 | 99076 | 3-14-2 | 332_1 | TCAtcacaaaataatttCC | -18 | 73.0 |
| 333 | TAGATCACATCATCACAA | 99068 | 99085 | 2-13-3 | 333_1 | TAgatcacatcatcaCAA | -19 | 26.6 |
| 334 | CCTAAATACCTTTCTTTTCA | 100896 | 100915 | 1-15-4 | 334_1 | CctaaatacctttcttTTCA | -22 | 39.6 |
| 335 | ATACCTAAATACCTTTCTT | 100900 | 100918 | 4-13-2 | 335_1 | ATACctaaatacctttcTT | -21 | 34.3 |
| 336 | CCCTAAATAATACCTAAACA | 100938 | 100957 | 3-15-2 | 336_1 | CCCtaaataatacctaaaCA | -22 | 98.9 |
| 337 | TCCACCCTAAATAATACC | 100944 | 100961 | 2-14-2 | 337_1 | TCcaccctaaataataCC | -21 | 47.6 |
| 338 | AGTTAACACTAATTCTACA | 101277 | 101295 | 3-12-4 | 338 | AGTtaacactaattcTACA | -21 | 34.2 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 339 | GTCTCTAATATTTCTATA | 101747 | 101764 | 3-11-4 | 339_1 | GTCtctaatatttcTATA | -21 | 21.9 |
| 340 | TAGCATTCATCTATCATT | 102745 | 102762 | 2-12-4 | 340_1 | TAgcattcatctatCATT | -21 | 32.7 |
| 341 | CCTAGCATTCATCTATC | 102748 | 102764 | 2-12-3 | 341_1 | CCtagcattcatctATC | -21 | 35.1 |
| 342 | GTTTCACATAATTTATTCC | 103244 | 103262 | 1-15-3 | 342_1 | GtttcacataatttatTCC | -19 | 37.3 |
| 343 | TTAGAATAAATTCACG | 103271 | 103286 | 5-5-6 | 343_1 | TTAGAataaaTTCACG | -20 | 110.8 |
| 344 | TAATTTCTCAAAAATTAAA | 104848 | 104867 | 7-5-8 | 344_1 | TAATTTCtcaaaAAATTAAA | -20 | 103.0 |
| 345 | CCTTCATTATTTCTCAATT | 107241 | 107259 | 2-13-4 | 345_1 | CCttcattatttctcAATT | -21 | 48.7 |
| 346 | CACAACCATCACTATTTC | 107587 | 107604 | 4-11-3 | 346_1 | CACAaccatcactatTTC | -22 | 21.6 |
| 347 | TTATTACAATCTATTTTACA | 107816 | 107835 | 4-12-4 | 347_1 | TTATtacaatctattTTACA | -21 | 26.9 |
| 348 | CACTCAATTCCATACTTAT | 107902 | 107920 | 3-13-3 | 348_1 | CACtcaattccatactTAT | -22 | 70.5 |
| 349 | ACTCAATTCCATACTTA | 107903 | 107919 | 2-11-4 | 349_1 | ACtcaattccataCTTA | -20 | 66.8 |
| 350 | TCTCTTTTAAATTCAATCT | 107954 | 107972 | 4-11-4 | 350_1 | TCTCttttaaattcaATCT | -22 | 44.7 |
| 351 | TATCTCTTTTAAATTCAATC | 107955 | 107974 | 4-12-4 | 351_1 | TATCtcttttaaattcAATC | -20 | 70.9 |
| 352 | GCTATCTCTTTTAAATTCA | 107958 | 107976 | 2-13-4 | 352_1 | GCtatctcttttaaaTTCA | -22 | 46.3 |
| 353 | GTAATTTATCAATTTCCA | 108181 | 108198 | 3-11-4 | 353_1 | GTAatttatcaattTCCA | -22 | 46.7 |
| 354 | AATCTTTTCTTAATCTTTTA | 113283 | 113302 | 4-12-4 | 354_1 | AATCttttcttaatctTTTA | -21 | 66.3 |
| 355 | GTACAATACCATTACAACA | 113456 | 113474 | 4-12-3 | 355_1 | GTACaataccattacaACA | -22 | 51.2 |
| 356 | CAGTTTTACTTTTCAATA | 113624 | 113641 | 4-10-4 | 356_1 | CAGTtttacttttcAATA | -21 | 15.9 |
| 357 | ATCAATTCTACTTAATACA | 114122 | 114140 | 4-11-4 | 357_1 | ATCAattctacttaaTACA | -21 | 24.7 |
| 358 | TATTCTTATTTTCATATATA | 115013 | 115032 | 3-13-4 | 358_1 | TATtcttattttcataTATA | -20 | 98.0 |
| 359 | ATATTCTTATTTTCATATA | 115015 | 115033 | 4-11-4 | 359_1 | ATATtcttattttcaTATA | -21 | 108.9 |
| 360 | AATGATCAATCACCCTT | 115389 | 115405 | 2-11-4 | 360_1 | AAtgatcaatcacCCTT | -20 | 48.1 |
| 361 | TTGATCTACTTAATTTA | 117183 | 117199 | 5-6-6 | 361_1 | TTGATctacttAATTTA | -21 | 108.2 |
| 362 | AGTCCCATAACTAACA | 117429 | 117444 | 4-8-4 | 362_1 | AGTCccataactAACA | -22 | 60.2 |
| 363 | TATCACTTATTCATTCATA | 117533 | 117551 | 3-12-4 | 363_1 | TATcacttattcattCATA | -22 | 32.7 |
| 364 | TTATCCATCTTTTAATTTA | 120075 | 120093 | 3-12-4 | 364_1 | TTAtccatcttttaaTTTA | -20 | 51.2 |
| 365 | ATATCTTTCCATATTTTCA | 120837 | 120856 | 2-14-4 | 365_1 | ATatctttccatatttTTCA | -22 | 31.4 |
| 366 | GGTAACAACTTTTAAATA | 122088 | 122105 | 4-7-7 | 366_1 | GGTAacaacttTTAAATA | -22 | 92.3 |
| 367 | CTAGTATACAACATCATA | 122809 | 122826 | 4-10-4 | 367_1 | CTAGtatacaacatCATA | -22 | 51.0 |
| 368 | ACCTAGTATACAACATC | 122812 | 122828 | 3-10-4 | 368_1 | ACCtagtatacaaCATC | -21 | 26.6 |
| 369 | ACCACATTAAATTCTCAAT | 122841 | 122859 | 4-11-4 | 369_1 | ACCAcattaaattctCAAT | -23 | 49.2 |
| 370 | TTACAACTTTATCTTTTTTA | 123014 | 123033 | 4-12-4 | 370_1 | TTACaactttatctttTTTA | -21 | 31.7 |
| 371 | ACAACCTATACCCTAT | 123731 | 123746 | 4-9-3 | 371_1 | ACAAcctataccTAT | -21 | 29.7 |
| 372 | AGGACAACCTATACCC | 123734 | 123749 | 1-11-4 | 372_1 | AggacaacctatACCC | -22 | 38.3 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 373 | TGATCTTTCTATCTACAC | 123918 | 123935 | 2-13-3 | 373_1 | TGatctttctatctaCAC | -19 | 113.5 |
| 374 | TTGATCTTTCTATCTACA | 123919 | 123936 | 2-13-3 | 374_1 | TTgatctttctatctACA | -18 | 115.1 |
| 375 | AGCCTTATTTAATAATC | 124037 | 124053 | 4-9-4 | 375_1 | AGCCttatttaatAATC | -21 | 102.4 |
| 376 | TGTCTTTATTTTCCAATC | 125837 | 125854 | 4-12-2 | 376_1 | TGTCtttattttccaaTC | -21 | 25.3 |
| 377 | TGTTTCCATAATATTTCT | 126386 | 126403 | 4-12-2 | 377_1 | TGTTtccataatatttCT | -20 | 36.0 |
| 378 | CCATATACCTTCTCCAT | 126732 | 126748 | 1-13-3 | 378_1 | CcatataccttctcCAT | -21 | 73.8 |
| 379 | TTTCCATATACCTTCTC | 126735 | 126751 | 4-11-2 | 379_1 | TTTCcatataccttcTC | -21 | 25.9 |
| 380 | TCTTTTCCATATACCTTC | 126737 | 126754 | 2-12-4 | 380_1 | TCttttccatatacCTTC | -23 | 27.7 |
| 381 | CACTATACAAAACTCTACCA | 127548 | 127567 | 3-15-2 | 381_1 | CACtatacaaaactctacCA | -21 | 103.7 |
| 382 | ACCCTCACTATACAAAAC | 127555 | 127572 | 4-12-2 | 382_1 | ACCCtcactatacaaaAC | -22 | 93.9 |
| 383 | CACCCTCACTATACAAA | 127557 | 127573 | 4-10-3 | 383_1 | CACCctcactatacAAA | -22 | 80.3 |
| 384 | AGCACAATATAAAACCAC | 128165 | 128182 | 3-11-4 | 384_1 | AGCacaatataaaaCCAC | -22 | 46.9 |
| 385 | TTAACATTATCTTTCCAA | 128646 | 128663 | 4-10-4 | 385_1 | TTAAcattatctttCCAA | -21 | 32.0 |
| 386 | CTAGCACTTTAATTTCCA | 130008 | 130025 | 1-14-3 | 386_1 | CtagcactttaatttCCA | -21 | 72.4 |
| 387 | GAATCTCTTCTTAACTCT | 131220 | 131237 | 3-13-2 | 387_1 | GAAtctcttcttaactCT | -19 | 48.6 |
| 388 | AAATAAATGACTATAACT | 132580 | 132597 | 6-5-7 | 388_1 | AAATAAatgacTATAACT | -20 | 102.4 |
| 389 | ACACCTTTCTAAACAATA | 132904 | 132921 | 4-10-4 | 389_1 | ACACctttctaaacAATA | -20 | 85.0 |
| 390 | AGTCTTTAAACCACTTTC | 133059 | 133076 | 4-12-2 | 390_1 | AGTCtttaaaccactTTC | -21 | 28.3 |
| 391 | ACCAAATAATTTCAACACC | 133229 | 133247 | 4-13-2 | 391_1 | ACCAaataatttcaacaCC | -22 | 88.5 |
| 392 | TCCCTCAACCAAATAATTT | 133236 | 133254 | 3-13-3 | 392_1 | TCCctcaaccaaataaTTT | -22 | 87.9 |
| 393 | TCCACCAGATTTTTCC | 133396 | 133411 | 2-12-2 | 393_1 | TCcaccagattttTCC | -21 | 30.9 |
| 394 | AAGCTTTCAAACCAAC | 133448 | 133463 | 4-10-2 | 394_1 | AAGCtttcaaaccaAC | -18 | 78.6 |
| 395 | TTATCCTAAAACTACCAT | 134579 | 134596 | 3-11-4 | 395_1 | TTAtcctaaaactaCCAT | -22 | 117.4 |
| 396 | AAGCACCTCATATCTTC | 134917 | 134933 | 2-11-4 | 396_1 | AAgcacctcatatCTTC | -21 | 85.2 |
| 397 | TTACCACTCATTTATTTCT | 135999 | 136017 | 4-13-2 | 397_1 | TTACcactcatttatttCT | -22 | 53.6 |
| 398 | AGTTACCACTCATTTAT | 136003 | 136019 | 3-10-4 | 398_1 | AGTtaccactcatTTAT | -21 | 41.4 |
| 399 | TACTCTAAAATTATCCTTA | 136533 | 136551 | 3-12-4 | 399_1 | TACtctaaaattatcCTTA | -20 | 83.1 |
| 400 | CAGATTCTTCTTATTCTA | 136566 | 136583 | 4-12-2 | 400_1 | CAGattcttcttattcTA | -21 | 80.9 |
| 401 | GTTCTAATATTCCTCACA | 138079 | 138096 | 2-13-3 | 401_1 | GTtctaatattcctcACA | -20 | 69.8 |
| 402 | CTCTTATCTTCCAATTTTA | 138305 | 138323 | 1-15-3 | 402_1 | CtcttatcttccaattTTA | -19 | 106.3 |
| 403 | TCTATAATTTCTTCTTATTT | 139861 | 139880 | 4-12-4 | 403_1 | TCTAtaatttcttcttATTT | -21 | 78.2 |
| 404 | CTTCTATAATTTCTTCTTA | 139864 | 139882 | 4-12-3 | 404_1 | CTTCtataatttcttcTTA | -21 | 38.6 |
| 405 | TCCTTCTATAATTTCTTCTT | 139865 | 139884 | 2-16-2 | 405_1 | TCccttctataatttcttcTT | -20 | 81.4 |
| 406 | ATTCCTTCTATAATTTCTT | 139868 | 139886 | 4-12-3 | 406_1 | ATTCcttctataatttcTT | -22 | 35.2 |
| 407 | CATTCCTTCTATAATTTCT | 139869 | 139887 | 2-13-4 | 407_1 | CAttccttctataatTTCT | -21 | 41.9 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 408 | ACATTCCTTCTATAATTTC | 139870 | 139888 | 4-12-3 | 408_1 | ACATccttctataatTTC | -21 | 39.6 |
| 409 | GCCATATCTCTTAATTTAA | 140051 | 140069 | 4-13-2 | 409_1 | GCCAtatctcttaatttAA | -22 | 68.7 |
| 410 | AGCCATATCTCTTAATT | 140054 | 140070 | 3-10-4 | 410_1 | AGCcatatctcttAATT | -21 | 40.8 |
| 411 | ACAGCCATATCTCTTAA | 140056 | 140072 | 4-10-3 | 411_1 | ACAGccatatctctTAA | -22 | 26.5 |
| 412 | TAAGTTTCAAATAACCC | 140590 | 140606 | 4-9-4 | 412_1 | TAAGtttcaaataACCC | -21 | 42.1 |
| 413 | TCCATTATTTTCCACTTA | 141294 | 141311 | 3-13-2 | 413_1 | TCCattattttccactTA | -22 | 25.5 |
| 414 | ACATCCATTATTTTCCAC | 141297 | 141314 | 3-12-3 | 414_1 | ACAtccattattttcCAC | -22 | 22.3 |
| 415 | TCACATCCATTATTTTCCA | 141298 | 141316 | 2-15-2 | 415_1 | TCacatccattattttcCA | -22 | 28.7 |
| 416 | TTCACATCCATTATTTTC | 141300 | 141317 | 4-10-4 | 416_1 | TTCAcatccattatTTTC | -22 | 26.2 |
| 417 | TCATTCACATCCATTATTT | 141302 | 141320 | 4-13-2 | 417_1 | TCATtcacatccattatTT | -21 | 38.5 |
| 418 | TTATATATTTATCTATTTCA | 141537 | 141556 | 4-12-4 | 418_1 | TTATatatttatctatTTCA | -20 | 33.1 |
| 419 | AGCAATACAATCAATACA | 141785 | 141802 | 4-10-4 | 419_1 | AGCAatacaatcaaTACA | -22 | 30.2 |
| 420 | CCACAATTACCATAACC | 141860 | 141876 | 4-11-2 | 420_1 | CCACaattaccataaCC | -23 | 45.9 |
| 421 | CACCAAAGATCTACCAA | 141996 | 142012 | 3-10-4 | 421_1 | CACcaaagatctaCCAA | -22 | 55.5 |
| 422 | TATTTTCTTACCCTCATT | 142656 | 142673 | 1-13-4 | 422_1 | TattttcttaccctCATT | -21 | 95.0 |
| 423 | AGTATTTTCTTACCCTCA | 142658 | 142675 | 1-15-2 | 423_1 | AgtattttcttaccctCA | -20 | 108.7 |
| 424 | TAGTATTTTCTTACCCT | 142660 | 142676 | 1-13-3 | 424_1 | TagtattttcttacCCT | -20 | 110.1 |
| 425 | TTAGTATTTTCTTACCC | 142661 | 142677 | 1-13-3 | 425_1 | TtagtattttcttaCCC | -20 | 109.3 |
| 426 | TTATAATTCCACTTACTTT | 143602 | 143620 | 3-12-4 | 426_1 | TTAtaattccacttaCTTT | -20 | 46.1 |
| 427 | GTTATAATTCCACTTACT | 143604 | 143621 | 4-11-3 | 427_1 | GTTAtaattccacttACT | -21 | 50.9 |
| 428 | TAGTTATAATTCCACTTA | 143606 | 143623 | 3-11-4 | 428_1 | TAGttataattccaCTTA | -21 | 112.9 |
| 429 | TTTAGTTATAATTCCAC | 143609 | 143625 | 4-9-4 | 429_1 | TTTAgttataattCCAC | -21 | 28.4 |
| 430 | GTTTTCTCAAATATAATT | 143624 | 143641 | 4-7-7 | 430_1 | GTTTtctcaaaTATAATT | -21 | 109.1 |
| 431 | GAATTCTAATACCACCTT | 144747 | 144764 | 3-11-4 | 431_1 | GAAttctaataccaCCTT | -23 | 51.4 |
| 432 | ATATACTAAACTATTCTCC | 144920 | 144938 | 3-12-4 | 432_1 | ATAtactaaactattCTCC | -22 | 78.0 |
| 433 | TTCATTTATCCTTCAAATA | 145012 | 145031 | 4-12-4 | 433_1 | TTCAttatccttcaaAATA | -22 | 39.2 |
| 434 | TTCATTATTTCATTTATCCT | 145020 | 145039 | 4-14-2 | 434_1 | TTCAttatttcatttatcCT | -22 | 44.3 |
| 435 | TTTAATCCTTTCTTTATTTC | 146253 | 146272 | 3-13-4 | 435_1 | TTTaatcctttctttaTTTC | -21 | 48.9 |
| 436 | CAGTTTTCTTTAATCCT | 146264 | 146281 | 2-13-3 | 436_1 | CAgttttctttaatCCT | -22 | 66.5 |
| 437 | ATGATCCTATTATTACCA | 146574 | 146591 | 4-12-2 | 437_1 | ATGAtcctattattacCA | -22 | 62.2 |
| 438 | TTGACTAACATTCATAA | 147223 | 147239 | 4-7-6 | 438_1 | TTGActaacatTCATAA | -21 | 88.7 |
| 439 | TTCCATCGCACATTTT | 147238 | 147253 | 4-9-3 | 439_1 | TTCCatcgcacatTTT | -22 | 41.2 |
| 440 | ACATAACCTTTATTTTTA | 148020 | 148039 | 4-12-4 | 440_1 | ACATaacctttatttTTTA | -22 | 32.5 |
| 441 | CATTCTAAATCTTAGTC | 148085 | 148101 | 2-9-6 | 441_1 | CAttctaaatcTTAGTC | -20 | 58.7 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 442 | ATAATCGTCCATCCCTT | 148288 | 148304 | 1-12-4 | 442_1 | AtaatcgtccatcCCTT | -23 | 32.0 |
| 443 | TCACATAAACTCATCCAA | 148809 | 148826 | 3-11-4 | 443_1 | TCAcataaactcatCCAA | -22 | 23.8 |
| 444 | TTCACATAAACTCATCC | 148811 | 148827 | 4-9-4 | 444_1 | TTCAcataaactcATCC | -22 | 33.0 |
| 445 | ACTTATTTCACATAAACTC | 148815 | 148833 | 4-11-4 | 445_1 | ACTTatttcacataaACTC | -21 | 20.1 |
| 446 | CTTCAAATAACTACAAAG | 149050 | 149067 | 6-5-7 | 446_1 | CTTCAAataacTACAAAG | -23 | 102.5 |
| 447 | TGTATTCATTACATACT | 149111 | 149127 | 3-10-4 | 447_1 | TGTattcattacaTACT | -20 | 94.2 |
| 448 | ACTCTTAACAATTTATTCA | 149131 | 149149 | 4-11-4 | 448_1 | ACTCttaacaatttaTTCA | -21 | 50.1 |
| 449 | TCACTCTTAACAATTTATTC | 149132 | 149151 | 4-12-4 | 449_1 | TCACtcttaacaatttATTC | -22 | 44.6 |
| 450 | TAACATAATCACTCTTAACA | 149140 | 149159 | 4-12-4 | 450_1 | TAACataatcactcttAACA | -20 | 47.4 |
| 451 | CCAGAACCTATTATTTA | 149630 | 149646 | 3-10-4 | 451_1 | CCAgaacctattaTTTA | -21 | 24.0 |
| 452 | ATTATTCAATCCTCTATA | 149720 | 149737 | 2-12-4 | 452_1 | ATtattcaatcctcTATA | -20 | 64.7 |
| 453 | TAACCTTCATCACATACT | 150502 | 150519 | 4-12-2 | 453_1 | TAACcttcatcacataCT | -21 | 40.0 |
| 454 | ATCTAACCTTCATCACATAC | 150503 | 150522 | 3-15-2 | 454_1 | ATCtaaccttcatcacatAC | -21 | 70.8 |
| 455 | TCTAACCTTCATCACATA | 150504 | 150521 | 2-12-4 | 455_1 | TCtaaccttcatcaCATA | -22 | 74.1 |
| 456 | CTCTATCTAACCTTCATC | 150509 | 150526 | 1-13-4 | 456_1 | CtctatctaaccttCATC | -21 | 38.2 |
| 457 | TGACTCTATCTAACCTTC | 150512 | 150529 | 2-14-2 | 457_1 | TGactctatctaaccttTC | -19 | 63.2 |
| 458 | CCTCTTTTATCAACACAATT | 150801 | 150820 | 2-14-4 | 458_1 | CCtcttttatcaacacAATT | -22 | 76.7 |
| 459 | TCTCCAAATCTTAAATTTC | 150860 | 150878 | 4-13-2 | 459_1 | TCTCcaaatcttaaattTC | -19 | 48.0 |
| 460 | TTTACTATTTCTCCAAATC | 150869 | 150887 | 3-13-3 | 460_1 | TTTactatttctccaaATC | -19 | 41.2 |
| 461 | TCTTTTACTATTTCTCCAAA | 150871 | 150890 | 2-14-4 | 461_1 | TCttttactatttctcCAAA | -21 | 39.5 |
| 462 | CATCTTTTACTATTTCTCCA | 150873 | 150892 | 2-16-2 | 462_1 | CAtcttttactatttctcCA | -22 | 72.6 |
| 463 | TCATCTTTTACTATTTCTC | 150875 | 150893 | 3-13-3 | 463_1 | TCAtcttttactatttCTC | -21 | 32.2 |
| 464 | CCTCATCTTTTACTATTT | 150878 | 150895 | 2-12-4 | 464_1 | CCtcatcttttactATTT | -21 | 62.8 |
| 465 | AACCTCATCTTTTACTA | 150881 | 150897 | 4-11-2 | 465_1 | AACCtcatcttttacTA | -20 | 53.8 |
| 466 | TTTTTATATCTACTCTCA | 150908 | 150925 | 3-11-4 | 466_1 | TTTttatatctactCTCA | -20 | 24.6 |
| 467 | TTAATAAACATCAATCTCC | 150999 | 151017 | 4-11-4 | 467_1 | TTAAtaaacatcaatCTCC | -21 | 32.8 |
| 468 | ATATTTCCTATTCTCCATT | 151333 | 151351 | 1-14-4 | 468_1 | AtatttcctattctcCATT | -22 | 48.4 |
| 469 | CATACTGCTCTTTCTA | 151839 | 151854 | 1-12-3 | 469_1 | CatactgctctttCTA | -18 | 46.8 |
| 470 | ATGCAAATAACTTCATCA | 155977 | 155994 | 4-11-3 | 470_1 | ATGCaaataacttcaTCA | -21 | 30.4 |
| 471 | TTTAACTTTCTTACCACAA | 156180 | 156198 | 4-11-4 | 471_1 | TTTAactttcttaccACAA | -21 | 25.3 |
| 472 | TTAACTTTCTTACCACA | 156181 | 156197 | 4-9-4 | 472_1 | TTAActttcttacCACA | -21 | 25.1 |
| 473 | CATATTCATCTCACCTAC | 168185 | 168202 | 2-12-4 | 473_1 | CAtattcatctcacCTAC | -22 | 68.5 |
| 474 | TCATATTCATCTCACCTA | 168186 | 168203 | 3-13-2 | 474_1 | TCAtattcatctcaccTA | -21 | 36.1 |
| 475 | TTCATATTCATCTCACCT | 168187 | 168204 | 4-12-2 | 475_1 | TTCAtattcatctcacCT | -22 | 22.8 |
| 476 | AATTTCATATTCATCTCAC | 168189 | 168208 | 4-12-4 | 476_1 | AATTtcatattcatcTCAC | -22 | 29.0 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 477 | CTACCTTTTTAATTCTAAAT | 169169 | 169188 | 4-12-4 | 477_1 | CTACctttttaattctAAAT | -21 | 64.2 |
| 478 | ACTACCTTTTTAATTCTA | 169172 | 169189 | 4-11-3 | 478_1 | ACTAcctttttaattCTA | -22 | 30.7 |
| 479 | TGACTACCTTTTTAATTC | 169174 | 169191 | 4-11-3 | 479_1 | TGACtaccttttaaTTC | -21 | 32.6 |
| 480 | TATATTTTTTACCCCT | 171639 | 171655 | 2-12-3 | 480_1 | TAtattttttaccCCT | -21 | 109.9 |
| 481 | TCAAATATACATCCTTG | 171786 | 171802 | 2-9-6 | 481_1 | TCaaatatacaTCCTTG | -21 | 50.4 |
| 482 | GTCAAATATACATCCT | 171788 | 171803 | 4-8-4 | 482_1 | GTCAaatatacaTCCT | -22 | 36.2 |
| 483 | GGTCAAATATACATCC | 171789 | 171804 | 4-8-4 | 483_1 | GGTCaaatatacATCC | -22 | 63.6 |
| 484 | AGGTCAAATATACATC | 171790 | 171805 | 4-8-4 | 484_1 | AGGTcaaatataCATC | -20 | 61.0 |
| 485 | ACCACATTTATCCAATATA | 171913 | 171931 | 4-13-2 | 485_1 | ACCAcatttatccaataTA | -22 | 29.8 |
| 486 | ATAAAAACCACATTTATCCA | 171918 | 171937 | 2-14-4 | 486_1 | ATaaaaaccacatttaTCCA | -22 | 39.2 |
| 487 | ATCACAACCACAAAATCA | 172016 | 172033 | 4-11-3 | 487_1 | ATCAcaaccacaaaaTCA | -21 | 45.0 |
| 488 | ATAAATATTCTTACCTACA | 172043 | 172061 | 4-11-4 | 488_1 | ATAAatattcttaccTACA | -21 | 81.9 |
| 489 | AAGTATAATTTCCTTCTA | 172270 | 172287 | 4-11-3 | 489_1 | AAGTataatttccttCTA | -21 | 41.3 |
| 490 | AATTTATAGATTAATAAAT | 173412 | 173430 | 7-5-7 | 490_1 | AATTTATagattAATAAAT | -19 | 105.9 |
| 491 | TTTCCACATATTTCCTAC | 173713 | 173730 | 2-12-4 | 491_1 | TTtccacatatttcCTAC | -22 | 56.2 |
| 492 | TGTCTATTTCCACATATT | 173719 | 173736 | 4-12-2 | 492_1 | TGTCtatttccacataTT | -21 | 37.6 |
| 493 | TCTTTCAACCTTTTATTTA | 173858 | 173876 | 2-13-4 | 493_1 | TCttttcaaccttttaTTTA | -20 | 58.1 |
| 494 | ATATAAATCACCTGAAAT | 175481 | 175498 | 4-7-7 | 494_1 | ATATaaatcacCTGAAAT | -23 | 82.6 |
| 495 | ATTAATTCCATCTTCCTT | 176374 | 176391 | 1-13-4 | 495_1 | AttaattccatcttCCTT | -21 | 32.8 |
| 496 | TCATTAATTCCATCTTCC | 176376 | 176393 | 3-13-2 | 496_1 | TCAttaattccatcttCC | -22 | 34.4 |
| 497 | TGTCATTAATTCCATCTT | 176378 | 176395 | 2-13-3 | 497_1 | TGtcattaattccatCTT | -20 | 52.1 |
| 498 | AACATGTCATTAATTCC | 176383 | 176399 | 4-9-4 | 498_1 | AACAtgtcattaaTTCC | -20 | 30.6 |
| 499 | CCTTCAACTGAACTTC | 176531 | 176546 | 2-11-3 | 499_1 | CCttcaactgaacTTC | -19 | 55.5 |
| 500 | AGCCATATCTTTTTTATT | 177145 | 177162 | 3-12-3 | 500_1 | AGCcatatcttttttATT | -21 | 60.2 |
| 501 | TAAGCACCTCAAAATATA | 177860 | 177877 | 2-12-4 | 501_1 | TAagcacctcaaaaTATA | -19 | 73.2 |
| 502 | TTATTCATACTAAACACATA | 178456 | 178475 | 4-12-4 | 502_1 | TTATtcatactaaacaCATA | -21 | 55.0 |
| 503 | AAAGATCTCATATTCCT | 178779 | 178795 | 3-10-4 | 503_1 | AAAgatctcatatTCCT | -20 | 29.0 |
| 504 | TCTCATTCTTTAACCATAA | 179038 | 179056 | 4-12-3 | 504_1 | TCTCattctttaaccaTAA | -22 | 39.9 |
| 505 | TCCCTACTTAAATTATCAA | 179303 | 179321 | 3-12-4 | 505_1 | TCCctacttaaattaTCAA | -22 | 64.8 |
| 506 | GCAATGTAAAAACATTAA | 179500 | 179517 | 5-6-7 | 506_1 | GCAATgtaaaaACATTAA | -22 | 101.2 |
| 507 | CCCATATTTTTATTTTACA | 179528 | 179547 | 2-15-3 | 507_1 | CCcatattttttattttACA | -22 | 72.1 |
| 508 | CCCTTATCTACAAAAATTTA | 180108 | 180127 | 3-14-3 | 508_1 | CCCttatctacaaaaatTTA | -22 | 79.0 |
| 509 | CTGCTTTATTTACATAT | 180433 | 180449 | 3-11-3 | 509_1 | CTGctttatttacaTAT | -19 | 68.6 |
| 510 | ACTGCTTTATTTACATA | 180434 | 180450 | 4-11-2 | 510_1 | ACTGctttatttacaTA | -19 | 66.9 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 511 | TCTCAAGTATAACTACA | 180753 | 180769 | 4-9-4 | 511_1 | TCTCaagtataacTACA | -21 | 63.4 |
| 512 | ACTGCTGAGCAGGATCA | 133475 | 133491 | 1-14-2 | 512_1 | ActgctgagcaggatCA | -20 | 84.7 |
| 512 | ACTGCTGAGCAGGATCA | 133475 | 133491 | 1-13-3 | 512_2 | ActgctgagcaggaTCA | -21 | 90.8 |
| 512 | ACTGCTGAGCAGGATCA | 133475 | 133491 | 2-13-2 | 512_3 | ACtgctgagcaggatCA | -22 | 98.0 |
| 513 | GCTGAGCAGGATCATGA | 133472 | 133488 | 1-14-2 | 513_1 | GctgagcaggatcatGA | -20 | 89.5 |
| 513 | GCTGAGCAGGATCATGA | 133472 | 133488 | 1-12-4 | 513_2 | GctgagcaggatcATGA | -22 | 90.2 |
| 513 | GCTGAGCAGGATCATGA | 133472 | 133488 | 1-13-3 | 513_3 | GctgagcaggatcaTGA | -21 | 91.2 |
| 513 | GCTGAGCAGGATCATGA | 133472 | 133488 | 2-13-2 | 513_4 | GCtgagcaggatcatGA | -22 | 96.8 |
| 514 | AAAATCCAGCCAGTTCCA | 70176 | 70193 | 1-15-2 | 514_1 | AaaatccagccagttcCA | -21 | 70.2 |
| 514 | AAAATCCAGCCAGTTCCA | 70176 | 70193 | 2-14-2 | 514_2 | AAaatccagccagttcCA | -22 | 77.3 |
| 514 | AAAATCCAGCCAGTTCCA | 70176 | 70193 | 3-13-2 | 514_3 | AAAatccagccagttcCA | -22 | 82.0 |
| 514 | AAAATCCAGCCAGTTCCA | 70176 | 70193 | 4-12-2 | 514_4 | AAAAtccagccagttcCA | -23 | 82.7 |
| 515 | ACTGCAATGTACATGTT | 176620 | 176636 | 1-12-4 | 515_1 | ActgcaatgtacaTGTT | -19 | 32.7 |
| 515 | ACTGCAATGTACATGTT | 176620 | 176636 | 3-12-2 | 515_2 | ACTgcaatgtacatgTT | -19 | 34.0 |
| 515 | ACTGCAATGTACATGTT | 176620 | 176636 | 4-11-2 | 515_3 | ACTGcaatgtacatgTT | -20 | 37.2 |
| 515 | ACTGCAATGTACATGTT | 176620 | 176636 | 2-11-4 | 515_4 | ACtgcaatgtacaTGTT | -20 | 43.2 |
| 515 | ACTGCAATGTACATGTT | 176620 | 176636 | 3-11-3 | 515_5 | ACTgcaatgtacatGTT | -20 | 45.3 |
| 515 | ACTGCAATGTACATGTT | 176620 | 176636 | 3-10-4 | 515_6 | ACTgcaatgtacaTGTT | -22 | 46.4 |
| 516 | TCTATTTGCTTAGCTG | 41022 | 41037 | 1-11-4 | 516_1 | TctatttgcttaGCTG | -20 | 10.3 |
| 516 | TCTATTTGCTTAGCTG | 41022 | 41037 | 1-12-3 | 516_2 | TctatttgcttagCTG | -18 | 10.4 |
| 516 | TCTATTTGCTTAGCTG | 41022 | 41037 | 2-12-2 | 516_3 | TCtatttgcttagcTG | -17 | 14.3 |
| 516 | TCTATTTGCTTAGCTG | 41022 | 41037 | 2-11-3 | 516_4 | TCtatttgcttagCTG | -19 | 36.2 |
| 516 | TCTATTTGCTTAGCTG | 41022 | 41037 | 3-11-2 | 516_5 | TCTatttgcttagcTG | -19 | 41.6 |
| 516 | TCTATTTGCTTAGCTG | 41022 | 41037 | 4-10-2 | 516_6 | TCTAtttgcttagcTG | -20 | 54.1 |
| 516 | TCTATTTGCTTAGCTG | 41022 | 41037 | 3-10-3 | 516_7 | TCTatttgcttagCTG | -21 | 64.6 |
| 517 | CTATTTGCTTAGCTGTT | 41020 | 41036 | 1-12-4 | 517_1 | CtatttgcttagcTGTT | -21 | 6.6 |
| 517 | CTATTTGCTTAGCTGTT | 41020 | 41036 | 1-13-3 | 517_2 | CtatttgcttagctGTT | -19 | 14.4 |
| 517 | CTATTTGCTTAGCTGTT | 41020 | 41036 | 2-13-2 | 517_3 | CTatttgcttagctgTT | -19 | 18.3 |
| 517 | CTATTTGCTTAGCTGTT | 41020 | 41036 | 2-12-3 | 517_4 | CTatttgcttagctGTT | -20 | 18.3 |
| 517 | CTATTTGCTTAGCTGTT | 41020 | 41036 | 3-12-2 | 517_5 | CTAtttgcttagctgTT | -20 | 18.7 |
| 517 | CTATTTGCTTAGCTGTT | 41020 | 41036 | 4-11-2 | 517_6 | CTATttgcttagctgTT | -21 | 32.4 |
| 517 | CTATTTGCTTAGCTGTT | 41020 | 41036 | 3-11-3 | 517_7 | CTAtttgcttagctGTT | -21 | 46.3 |
| 517 | CTATTTGCTTAGCTGTT | 41020 | 41036 | 2-11-4 | 517_8 | CTatttgcttagcTGTT | -22 | 56.2 |
| 518 | CTGAGCAGGATCATGA | 133472 | 133487 | 1-12-3 | 518_1 | CtgagcaggatcaTGA | -19 | 78.6 |
| 518 | CTGAGCAGGATCATGA | 133472 | 133487 | 2-12-2 | 518_2 | CTgagcaggatcatGA | -19 | 88.3 |

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 518 | CTGAGCAGGATCATGA | 133472 | 133487 | 2-11-3 | 518_3 | CTgagcaggatcaTGA | -21 | 92.1 |
| 518 | CTGAGCAGGATCATGA | 133472 | 133487 | 3-11-2 | 518_4 | CTGagcaggatcatGA | -20 | 92.5 |
| 518 | CTGAGCAGGATCATGA | 133472 | 133487 | 2-10-4 | 518_5 | CTgagcaggatcATGA | -22 | 99.7 |
| 518 | CTGAGCAGGATCATGA | 133472 | 133487 | 1-11-4 | 518_6 | CtgagcaggatcATGA | -20 | 99.9 |
| 519 | AAAATCCAGCCAGTTCC | 70177 | 70193 | 1-13-3 | 519_1 | AaaatccagccagtTCC | -21 | 44.5 |
| 519 | AAAATCCAGCCAGTTCC | 70177 | 70193 | 2-13-2 | 519_2 | AAaatccagccagttCC | -21 | 49.4 |
| 519 | AAAATCCAGCCAGTTCC | 70177 | 70193 | 2-12-3 | 519_3 | AAaatccagccagtTCC | -22 | 62.1 |
| 519 | AAAATCCAGCCAGTTCC | 70177 | 70193 | 3-12-2 | 519_4 | AAAatccagccagttCC | -21 | 63.4 |
| 519 | AAAATCCAGCCAGTTCC | 70177 | 70193 | 4-11-2 | 519_5 | AAAAtccagccagttCC | -22 | 71.1 |
| 519 | AAAATCCAGCCAGTTCC | 70177 | 70193 | 3-11-3 | 519_6 | AAAatccagccagtTCC | -22 | 71.9 |
| 520 | TCTATTTGCTTAGCTGT | 41021 | 41037 | 1-13-3 | 520_1 | TctatttgcttagcTGT | -20 | 9.2 |
| 520 | TCTATTTGCTTAGCTGT | 41021 | 41037 | 2-13-2 | 520_2 | TCtatttgcttagctGT | -19 | 12.3 |
| 520 | TCTATTTGCTTAGCTGT | 41021 | 41037 | 2-12-3 | 520_3 | TCtatttgcttagcTGT | -21 | 19.0 |
| 520 | TCTATTTGCTTAGCTGT | 41021 | 41037 | 3-12-2 | 520_4 | TCTatttgcttagctGT | -21 | 47.1 |
| 520 | TCTATTTGCTTAGCTGT | 41021 | 41037 | 4-11-2 | 520_5 | TCTAtttgcttagctGT | -22 | 54.6 |
| 521 | TCTATTTGCTTAGCTGTT | 41020 | 41037 | 1-14-3 | 521_1 | TctatttgcttagctGTT | -20 | 7.1 |
| 521 | TCTATTTGCTTAGCTGTT | 41020 | 41037 | 2-14-2 | 521_2 | TCtatttgcttagctgTT | -20 | 14.3 |
| 521 | TCTATTTGCTTAGCTGTT | 41020 | 41037 | 2-13-3 | 521_3 | TCtatttgcttagcTGTT | -21 | 24.3 |
| 521 | TCTATTTGCTTAGCTGTT | 41020 | 41037 | 3-12-3 | 521_4 | TCTatttgcttagctGTT | -23 | 54.2 |
| 521 | TCTATTTGCTTAGCTGTT | 41020 | 41037 | 1-13-4 | 521_5 | TctatttgcttagcTGTT | -21 | 60.3 |
| 522 | TGCTGAGCAGGATCAT | 133474 | 133489 | 2-12-2 | 522_1 | TGctgagcaggatcAT | -19 | 71.9 |
| 522 | TGCTGAGCAGGATCAT | 133474 | 133489 | 2-11-3 | 522_2 | TGctgagcaggatCAT | -21 | 76.7 |
| 522 | TGCTGAGCAGGATCAT | 133474 | 133489 | 2-10-4 | 522_3 | TGctgagcaggaTCAT | -22 | 88.1 |
| 522 | TGCTGAGCAGGATCAT | 133474 | 133489 | 3-11-2 | 522_4 | TGCtgagcaggatcAT | -22 | 90.2 |
| 523 | ACTGCAATGTACATGT | 176621 | 176636 | 2-11-3 | 523_1 | ACtgcaatgtacaTGT | -18 | 32.0 |
| 523 | ACTGCAATGTACATGT | 176621 | 176636 | 4-10-2 | 523_2 | ACTGcaatgtacatGT | -19 | 33.0 |
| 523 | ACTGCAATGTACATGT | 176621 | 176636 | 2-10-4 | 523_3 | ACtgcaatgtacATGT | -19 | 41.6 |
| 523 | ACTGCAATGTACATGT | 176621 | 176636 | 3-10-3 | 523_4 | ACTgcaatgtacaTGT | -20 | 42.9 |
| 523 | ACTGCAATGTACATGT | 176621 | 176636 | 4-8-4 | 523_5 | ACTGcaatgtacATGT | -22 | 60.7 |
| 524 | ATTAGGTTCTCTAAT | 180266 | 180280 | 4-7-4 | 524_1 | ATTAggttctcTAAT | -18 | 110.1 |
| 525 | ACTGCAATGTACATG | 176622 | 176636 | 4-7-4 | 525_1 | ACTGcaatgtaCATG | -20 | 79.6 |
| 526 | GCAATGTACATGTTCAC | 176617 | 176633 | 3-11-3 | 526_1 | GCAatgtacatgttCAC | -21 | 15.4 |
| 527 | CAATGTACATGTTCAC | 176617 | 176632 | 4-8-4 | 527_1 | CAATgtacatgtTCAC | -20 | 18.2 |
| 528 | GTAGATGAACATGACCAG | 176320 | 176337 | 3-12-3 | 528_1 | GTAgatgaacatgacCAG | -22 | 10.3 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 529 | GTAGATGAACATGACCAGGA | 176318 | 176337 | 1-16-3 | 529_1 | GtagatgaacatgaccaGGA | −23 | 32.0 |
| 530 | GTAGATGAACATGACCA | 176321 | 176337 | 3-11-3 | 530_1 | GTAgatgaacatgaCCA | −22 | 10.5 |
| 531 | GTAGATGAACATGACCAGG | 176319 | 176337 | 1-14-4 | 531_1 | GtagatgaacatgacCAGG | −23 | 35.0 |
| 532 | TAGATGAACATGACC | 176322 | 176336 | 4-7-4 | 532_1 | TAGAtgaacatGACC | −20 | 6.4 |
| 533 | TAGATGAACATGACCA | 176321 | 176336 | 4-9-3 | 533_1 | TAGAtgaacatgaCCA | −21 | 5.1 |
| 534 | TAGATGAACATGACCAGG | 176319 | 176336 | 3-12-3 | 534_1 | TAGatgaacatgaccAGG | −22 | 6.7 |
| 535 | TAGATGAACATGACCAGGA | 176318 | 176336 | 3-14-2 | 535_1 | TAGatgaacatgaccagGA | −22 | 20.3 |
| 536 | TAGATGAACATGACCAGGAA | 176317 | 176336 | 4-14-2 | 536_1 | TAGAtgaacatgaccaggAA | −23 | 23.1 |
| 537 | AGATGAACATGACCAGGA | 176318 | 176335 | 1-13-4 | 537_1 | AgatgaacatgaccAGGA | −22 | 9.4 |
| 538 | AGATGAACATGACCAGG | 176319 | 176335 | 2-11-4 | 538_1 | AGatgaacatgacCAGG | −22 | 15.0 |
| 539 | AGATGAACATGACCAGGAA | 176317 | 176335 | 2-13-4 | 539_1 | AGatgaacatgaccaGGAA | −23 | 12.0 |
| 540 | GATGAACATGACCAGG | 176319 | 176334 | 4-9-3 | 540_1 | GATGaacatgaccAGG | −22 | 4.1 |
| 541 | GATGAACATGACCAGGAA | 176317 | 176334 | 4-11-3 | 541_1 | GATGaacatgaccagGAA | −23 | 8.8 |
| 542 | GATGAACATGACCAGGA | 176318 | 176334 | 2-11-4 | 542_1 | GAtgaacatgaccAGGA | −22 | 7.5 |
| 543 | ATGAACATGACCAGGA | 176318 | 176333 | 3-9-4 | 543_1 | ATGaacatgaccAGGA | −22 | 9.4 |
| 544 | TGAACATGACCAGGAA | 176317 | 176332 | 4-8-4 | 544_1 | TGAAcatgaccaGGAA | −22 | 9.4 |
| 545 | GTGAAGTAGTAGTG | 171984 | 171997 | 4-7-3 | 545_1 | GTGAagtagtaGTG | −18 | 31.4 |
| 546 | ACTTATCTTCTTTTTCTGTT | 149422 | 149441 | 1-15-4 | 546_1 | ActtatcttcttttcTGTT | −22 | 104.7 |
| 547 | ACTTATCTTCTTTTTCTGT | 149423 | 149441 | 1-14-4 | 547_1 | ActtatcttcttttCTGT | −22 | 96.4 |
| 548 | CTTATCTTCTTTTTCTGT | 149423 | 149440 | 1-13-4 | 548_1 | CttatcttcttttCTGT | −21 | 90.3 |
| 549 | CTTATCTTCTTTTTCTGTTG | 149421 | 149440 | 2-15-3 | 549_1 | CTtatcttcttttctgTTG | −22 | 96.2 |
| 550 | CTTATCTTCTTTTTCTGTT | 149422 | 149440 | 1-14-4 | 550_1 | CttatcttcttttcTGTT | −22 | 102.8 |
| 551 | TTATCTTCTTTTTCTGTT | 149422 | 149439 | 4-12-2 | 551_1 | TTATcttcttttctgTT | −20 | 72.0 |
| 552 | TTATCTTCTTTTTCTGT | 149423 | 149439 | 1-12-4 | 552_1 | TtatcttcttttCTGT | −19 | 101.0 |
| 553 | TTATCTTCTTTTTCTGTTG | 149421 | 149439 | 4-13-2 | 553_1 | TTATcttcttttctgtTG | −21 | 70.7 |
| 554 | TATCTTCTTTTTCTGTTG | 149421 | 149438 | 3-12-3 | 554_1 | TATcttcttttctgTTG | −21 | 71.8 |
| 555 | ATCTTCTTTTTCTGTTG | 149421 | 149437 | 3-11-3 | 555_1 | ATCttcttttctgTTG | −20 | 60.0 |
| 556 | TCCCATGATGCTGAA | 147108 | 147122 | 4-9-2 | 556_1 | TCCCatgatgctgAA | −22 | 61.0 |
| 557 | ACTGCTGAGCAGGATCAT | 133474 | 133491 | 1-14-3 | 557_1 | ActgctgagcaggatCAT | −22 | 98.9 |
| 558 | CTGCTGAGCAGGATCAT | 133474 | 133490 | 1-13-3 | 558_1 | CtgctgagcaggatCAT | −22 | 85.9 |
| 559 | TGCTGAGCAGGATCATG | 133473 | 133489 | 2-13-2 | 559_1 | TGctgagcaggatcaTG | −21 | 88.2 |
| 560 | TGAGCAGGATCATGA | 133472 | 133486 | 3-8-4 | 560_1 | TGAgcaggatcATGA | −21 | 118.1 |
| 561 | TCTCTATCCACTCTCCA | 98920 | 98936 | 1-14-2 | 561_1 | TctctatccactctcCA | −21 | 75.8 |
| 562 | CTCTATCCACTCTCCA | 98920 | 98935 | 1-12-3 | 562_1 | CtctatccactctCCA | −23 | 52.3 |
| 563 | CTCTATCCACTCTCCAC | 98919 | 98935 | 1-13-3 | 563_1 | CtctatccactctcCAC | −23 | 63.8 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 564 | CTCTATCCACTCTCCACA | 98918 | 98935 | 1-13-4 | 564_1 | CtctatccactctcCACA | -26 | 35.7 |
| 565 | GGAAGGAGTGGAAGAAGTCG | 98878 | 98897 | 2-16-2 | 565_1 | GGaaggagtggaagaagtCG | -22 | 70.8 |
| 566 | GAAGGAGTGGAAGAAGTCGT | 98877 | 98896 | 1-16-3 | 566_1 | GaaggagtggaagaagtCGT | -22 | 71.6 |
| 567 | GAAGGAGTGGAAGAAGTCG | 98878 | 98896 | 3-13-3 | 567_1 | GAaggagtggaagaagTCG | -22 | 70.7 |
| 568 | AAGGAGTGGAAGAAGTCG | 98878 | 98895 | 3-11-4 | 568_1 | AAGgagtggaagaaGTCG | -23 | 21.2 |
| 569 | AAGGAGTGGAAGAAGTCGT | 98877 | 98895 | 2-13-4 | 569_1 | AAggagtggaagaagTCGT | -23 | 29.5 |
| 570 | AGGAGTGGAAGAAGTCG | 98878 | 98894 | 2-11-4 | 570_1 | AGgagtggaagaaGTCG | -22 | 23.2 |
| 571 | AGGAGTGGAAGAAGTCGT | 98877 | 98894 | 1-13-4 | 571_1 | AggagtggaagaagTCGT | -22 | 37.9 |
| 572 | GGAGTGGAAGAAGTCG | 98878 | 98893 | 4-10-2 | 572_1 | GGAGtggaagaagtCG | -21 | 40.9 |
| 573 | GGAGTGGAAGAAGTCGT | 98877 | 98893 | 3-12-2 | 573_1 | GGAgtggaagaagtcGT | -22 | 44.1 |
| 574 | GAGTGGAAGAAGTCGTTC | 98875 | 98892 | 2-12-4 | 574_1 | GAgtggaagaagtcGTTC | -22 | 28.0 |
| 575 | GAGTGGAAGAAGTCGTT | 98876 | 98892 | 4-11-2 | 575_1 | GAGTggaagaagtcgTT | -22 | 40.6 |
| 576 | GAGTGGAAGAAGTCGTTCAT | 98873 | 98892 | 1-15-4 | 576_1 | GagtggaagaagtcgtTCAT | -23 | 65.1 |
| 577 | GAGTGGAAGAAGTCG | 98878 | 98892 | 4-7-4 | 577_1 | GAGTggaagaaGTCG | -22 | 99.7 |
| 578 | GAGTGGAAGAAGTCGTTCA | 98874 | 98892 | 1-14-4 | 578_1 | GagtggaagaagtcgTTCA | -22 | 52.8 |
| 579 | GAGTGGAAGAAGTCGT | 98877 | 98892 | 3-9-4 | 579_1 | GAGtggaagaagTCGT | -22 | 71.2 |
| 580 | AGTGGAAGAAGTCGTTCA | 98874 | 98891 | 2-12-4 | 580_1 | AGtggaagaagtcgTTCA | -22 | 38.3 |
| 581 | AGTGGAAGAAGTCGTTCAT | 98873 | 98891 | 1-14-4 | 581_1 | AgtggaagaagtcgtTCAT | -22 | 59.0 |
| 582 | AGTGGAAGAAGTCGTTCATG | 98872 | 98891 | 2-16-2 | 582_1 | AGtggaagaagtcgttcaTG | -22 | 87.1 |
| 583 | AGTGGAAGAAGTCGT | 98877 | 98891 | 3-8-4 | 583_1 | AGTggaagaagTCGT | -21 | 68.1 |
| 584 | AGTGGAAGAAGTCGTT | 98876 | 98891 | 3-9-4 | 584_1 | AGTggaagaagtCGTT | -21 | 32.2 |
| 585 | AGTGGAAGAAGTCGTTC | 98875 | 98891 | 3-10-4 | 585_1 | AGTggaagaagtcGTTC | -22 | 17.6 |
| 586 | GTGGAAGAAGTCGTTC | 98875 | 98890 | 3-9-4 | 586_1 | GTGgaagaagtcGTTC | -21 | 16.6 |
| 587 | GTGGAAGAAGTCGT | 98877 | 98890 | 3-7-4 | 587_1 | GTGgaagaagTCGT | -20 | 73.5 |
| 588 | GTGGAAGAAGTCGTTCAT | 98873 | 98890 | 4-12-2 | 588_1 | GTGGaagaagtcgttcAT | -23 | 48.0 |
| 589 | GTGGAAGAAGTCGTTCATG | 98872 | 98890 | 1-14-4 | 589_1 | GtggaagaagtcgttCATG | -22 | 71.8 |
| 590 | GTGGAAGAAGTCGTTCA | 98874 | 98890 | 2-11-4 | 590_1 | GTggaagaagtcgTTCA | -22 | 27.8 |
| 591 | GTGGAAGAAGTCGTTCATGT | 98871 | 98890 | 1-16-3 | 591_1 | GtggaagaagtcgttcaTGT | -23 | 82.0 |
| 592 | GTGGAAGAAGTCGTT | 98876 | 98890 | 3-8-4 | 592_1 | GTGgaagaagtCGTT | -21 | 34.1 |
| 593 | TGGAAGAAGTCGTTCATGTG | 98870 | 98889 | 2-16-2 | 593_1 | TGgaagaagtcgttcatgTG | -22 | 65.8 |
| 594 | TGGAAGAAGTCGTTCA | 98874 | 98889 | 4-10-2 | 594_1 | TGGAagaagtcgttCA | -21 | 21.3 |
| 595 | TGGAAGAAGTCGTTCATG | 98872 | 98889 | 2-12-4 | 595_1 | TGgaagaagtcgttCATG | -22 | 49.3 |
| 596 | TGGAAGAAGTCGTTC | 98875 | 98889 | 4-7-4 | 596_1 | TGGAagaagtcGTTC | -21 | 86.5 |
| 597 | TGGAAGAAGTCGTTCAT | 98873 | 98889 | 3-10-4 | 597_1 | TGGaagaagtcgtTCAT | -22 | 82.1 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 598 | TGGAAGAAGTCGTTCATGT | 98871 | 98889 | 3-14-2 | 598_1 | TGGaagaagtcgttcatGT | -22 | 42.0 |
| 599 | GGAAGAAGTCGTTCA | 98874 | 98888 | 3-8-4 | 599_1 | GGAagaagtcgTTCA | -20 | 106.6 |
| 600 | GGAAGAAGTCGTTCAT | 98873 | 98888 | 4-9-3 | 600_1 | GGAAgaagtcgttCAT | -21 | 30.3 |
| 601 | GGAAGAAGTCGTTCATGT | 98871 | 98888 | 2-13-3 | 601_1 | GGaagaagtcgttcaTGT | -22 | 34.6 |
| 602 | GGAAGAAGTCGTTCATGTGC | 98869 | 98888 | 1-17-2 | 602_1 | GgaagaagtcgttcatgtGC | -23 | 70.1 |
| 603 | GGAAGAAGTCGTTCATG | 98872 | 98888 | 4-10-3 | 603_1 | GGAAgaagtcgttcATG | -22 | 17.9 |
| 604 | GGAAGAAGTCGTTCATGTG | 98870 | 98888 | 2-14-3 | 604_1 | GGaagaagtcgttcatGTG | -22 | 20.3 |
| 605 | GAAGAAGTCGTTCATGTG | 98870 | 98887 | 2-12-4 | 605_1 | GAagaagtcgttcaTGTG | -22 | 20.4 |
| 606 | GAAGAAGTCGTTCATGTGC | 98869 | 98887 | 1-15-3 | 606_1 | GaagaagtcgttcatgTGC | -22 | 52.0 |
| 607 | GAAGAAGTCGTTCATGTGCC | 98868 | 98887 | 1-16-3 | 607_1 | GaagaagtcgttcatgtGCC | -25 | 49.3 |
| 608 | GAAGAAGTCGTTCAT | 98873 | 98887 | 4-7-4 | 608_1 | GAAGaagtcgtTCAT | -19 | 114.8 |
| 609 | GAAGAAGTCGTTCATG | 98872 | 98887 | 4-8-4 | 609_1 | GAAGaagtcgttCATG | -21 | 86.8 |
| 610 | GAAGAAGTCGTTCATGT | 98871 | 98887 | 4-10-3 | 610_1 | GAAGaagtcgttcaTGT | -22 | 18.5 |
| 611 | AAGAAGTCGTTCATGT | 98871 | 98886 | 4-8-4 | 611_1 | AAGAagtcgttcATGT | -21 | 59.0 |
| 612 | AAGAAGTCGTTCATGTGC | 98869 | 98886 | 1-13-4 | 612_1 | AagaagtcgttcatGTGC | -22 | 33.6 |
| 613 | AAGAAGTCGTTCATGTGCCA | 98867 | 98886 | 1-17-2 | 613_1 | AagaagtcgttcatgtgcCA | -23 | 64.9 |
| 614 | AAGAAGTCGTTCATG | 98872 | 98886 | 4-7-4 | 614_1 | AAGAagtcgttCATG | -19 | 100.1 |
| 615 | AAGAAGTCGTTCAT | 98873 | 98886 | 4-6-4 | 615_1 | AAGAagtcgTCAT | -18 | 95.9 |
| 616 | AAGAAGTCGTTCATGTGCC | 98868 | 98886 | 2-15-2 | 616_1 | AAgaagtcgttcatgtgCC | -23 | 38.7 |
| 617 | AAGAAGTCGTTCATGTG | 98870 | 98886 | 3-10-4 | 617_1 | AAGaagtcgttcaTGTG | -21 | 15.7 |
| 618 | AGAAGTCGTTCATGTGCC | 98868 | 98885 | 1-15-2 | 618_1 | AgaagtcgttcatgtGCC | -22 | 36.5 |
| 619 | AGAAGTCGTTCATGTG | 98870 | 98885 | 2-10-4 | 619_1 | AGaagtcgttcaTGTG | -20 | 13.4 |
| 620 | AGAAGTCGTTCATGT | 98871 | 98885 | 4-7-4 | 620_1 | AGAagtcgttcATGT | -21 | 59.2 |
| 621 | AGAAGTCGTTCATGTGC | 98869 | 98885 | 3-12-2 | 621_1 | AGAagtcgttcatgtGC | -22 | 8.8 |
| 622 | AGAAGTCGTTCATG | 98872 | 98885 | 4-6-4 | 622_1 | AGAagtcgttCATG | -20 | 93.7 |
| 623 | AGAAGTCGTTCATGTGCCA | 98867 | 98885 | 1-16-2 | 623_1 | AgaagtcgttcatgtgCA | -23 | 43.3 |
| 624 | GAAGTCGTTCATGTGCC | 98868 | 98884 | 1-13-3 | 624_1 | GaagtcgttcatgtGCC | -23 | 18.0 |
| 625 | GAAGTCGTTCATGTGCCA | 98867 | 98884 | 1-15-2 | 625_1 | GaagtcgttcatgtgCA | -22 | 36.7 |
| 626 | GAAGTCGTTCATGTGC | 98869 | 98884 | 4-10-2 | 626_1 | GAAGtcgttcatgtGC | -22 | 9.6 |
| 627 | AAGTCGTTCATGTGCC | 98868 | 98883 | 2-11-3 | 627_1 | AAgtcgttcatgtGCC | -22 | 7.8 |
| 628 | AAGTCGTTCATGTGCCA | 98867 | 98883 | 3-12-2 | 628_1 | AAGtcgttcatgtgCA | -22 | 7.1 |
| 629 | AGTCGTTCATGTGCC | 98868 | 98882 | 1-11-3 | 629_1 | AgtcgttcatgtGCC | -21 | 9.2 |
| 630 | AGTCGTTCATGTGCCA | 98867 | 98882 | 2-12-2 | 630_1 | AGtcgttcatgtgCA | -22 | 12.1 |
| 631 | GTCGTTCATGTGCC | 98868 | 98881 | 1-10-3 | 631_1 | GtcgttcatgtGCC | -20 | 11.5 |

-continued

Compound Table

| SEQ ID NO | Motif sequence | position on SEQ ID NO: 1 Start | end | Design | CMP ID NO | Oligonucleotide Compound | dG | SNC9A mRNA % (vs Saline control 100%) |
|---|---|---|---|---|---|---|---|---|
| 632 | TCGTTCATGTGCCA | 98867 | 98880 | 4-8-2 | 632_1 | TCGTtcatgtgcCA | -21 | 3.8 |
| 633 | GGCCAGGATTTTGCCA | 98679 | 98694 | 1-13-2 | 633_1 | GgccaggattttgcCA | -22 | 88.1 |
| 634 | GGCCAGGATTTTGCC | 98680 | 98694 | 1-12-2 | 634_1 | GgccaggattttgCC | -22 | 108.7 |
| 635 | TCAAAGCTCGTGTAG | 82684 | 82698 | 4-7-4 | 635_1 | TCAAagctcgtGTAG | -21 | 27.4 |
| 636 | CAAAGCTCGTGTAG | 82684 | 82697 | 3-7-4 | 636_1 | CAAagctcgtGTAG | -18 | 12.9 |
| 637 | AAAGTTCGAAGAGCTG | 71708 | 71723 | 4-8-4 | 637_1 | AAAGttcgaagaGCTG | -21 | 102.9 |
| 638 | TATTTGCTTAGCTGTT | 41020 | 41035 | 4-8-4 | 638_1 | TATTtgcttagcTGTT | -22 | 18.1 |
| 639 | GTAGATGAACATGACC | 176322 | 176337 | 3-9-4 | 639 | GTAgatgaacatGACC | -21 | 19.8 |
| 640 | TAGATGAACATGACCAG | 176320 | 176336 | 4-10-3 | 640_1 | TAGAtgaacatgacCAG | -22 | 8.1 |
| 641 | ATGAACATGACCAGGAA | 176317 | 176333 | 3-10-4 | 641_1 | ATGaacatgaccaGGAA | -21 | 9.1 |
| 642 | TTCACTAAATTTCACTAATC | 64574 | 64593 | 4-12-4 | 642_1 | TTCActaaatttcactAATC | -20 | 20.2 |
| 643 | AATGTACTTATACCCA | 69498 | 69513 | 1-11-4 | 643_1 | AatgtacttataCCCA | -20 | 71.9 |
| 644 | CTTACGCAAAAACAAT | 70200 | 70215 | 5-5-6 | 644_1 | CTTACgcaaaAACAAT | -20 | 84.8 |
| 645 | ACTTACGCAAAAACAAT | 70200 | 70216 | 4-8-5 | 645_1 | ACTTacgcaaaaACAAT | -19 | 94.9 |
| 646 | TCACACCAATTACTTCTT | 71767 | 71784 | 2-13-3 | 646_1 | TCacaccaattacttCTT | -20 | 43.1 |
| 647 | CTTCACACCAATTACTTCTT | 71767 | 71786 | 1-16-3 | 647_1 | CttcacaccaattacttCTT | -22 | 81.2 |
| 648 | TTACTTTATTCATCTCATA | 86908 | 86926 | 3-13-3 | 648_1 | TTActtattcatctcATA | -20 | 47.0 |
| 649 | TACTTTATTCATCTCATA | 86908 | 86925 | 3-13-2 | 649_1 | TACttattcatctcaTA | -18 | 80.3 |
| 650 | TTGAACCTTCATTATTTC | 107247 | 107264 | 4-11-3 | 650_1 | TTGAaccttcattatTTC | -20 | 20 |

SEQUENCE LISTING (653 sequences)

SEQ ID NO: 1 - DNA, 180817 bp, homo sapiens
tgccctcggggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaa

SEQ ID NO: 2 - DNA, 119156 bp, macaca fascicularis
  misc_feature (16458)..(18257): n is a, c, g, or t
  misc_feature (24073)..(24242): n is a, c, g, or t
  misc_feature (54952)..(55249): n is a, c, g, or t
ttactccaccagaaatcgcaaatcttaaactaaataccggactgatgaaaactcctgtggcctgtttatccagaagactaagggaagaggaaagaagttgtagtcacacgtaggtcctccctcatcattgcatattctttgtgtgtgttggtgaagtgtgaggctccatttttacttatgttgccctctgtcaccctgtcagcccatcatcttgccaccccactggccctgtacaataacttccaagcaaactcagatgccaactaaagctgctcttcttcaaagctataaaactagtaaaatgaaaggaagtttcacctctccaaactagaggatgaggatgaaatctgatcaaggtctcttcaacttatatttcacagaccatgatgttaagcaggttcttagtgtcttcctttaatttagcttgatcagggaaatattgcccatgcatggtaccactagcattgaccaccctttgcctctgctttttgtataaactttagtcattctggagctgtgttgagcatgtgcatgggggtcagtagagacagagacagaagagaataggaatattggaagagtcgaactgataatgggcatcggagttcacaacatctgtgtacctagatttttctcaaataattattgaaagaggtggtaccctccagttgaatgcagaatctaccaaaacaccagttattcaagccaatttttcttcaagagccacgttatgtctacactgaaagtgtagtgaggcaagttattccaacctctcacctttatgattttcaaaagtgttgaggaatccccaaagcacaagtggcaactgctttgatttgattcattgatttgtttccattttactaaatctcttcctattctgaggacaattttcacatattttatgatccaaaattattaatgcatattcgtagtagttttattgaggtataatttacacaccataaaaatcaccattttaaagtgtaccactcagtggtttttcgtatgttcaggaaggtatgcaaccatcataattacataattttagaatatttttatcacccccaaagacgtcccatactctttaaccgttaaccacataaccatcaatagtcacttcctattacacctagcctctgaaaaaaaaatactctacattttgtttctggggatttgcctactctggacatttcataagatggaatcatataatatgtgaccttttggctctgtgttccttcacagagttttcatcacatccatgttgtaacatgtacctatacttcatttgtttttattgctaactattaattcagtgtgtgaatatcccacgcttttatccatttattcattggtgagtaattaggttgtgtttactttctggctactatgaataatgctgctgaacattcatgtaaacctttttgtgtggacatatgttttaaattcccttgagtctgtacctagtagtagaattgccaagtcataacttactctttacctttcagaatcatcctacttttgaatgtgtacatgcagtgtcccttatttttcactacattctttaaaaaactttatcttaactttggtttccaacaaaatacaggcatagttcattttatggggctttgctttattgcacttcaagatactgcatttcttacaagttgaaggtttgtggcaaccctgcattgagcaagtctgtcagcataattttttcaacagcatgtgctcacttcatgcatctgtgtcacactgtggcaattctcacaatatttcaaactttgtaattgctattatttattattactatgtatgttatggtgatctatgatcagtgatctttgttgttactatggtaattgttttgaggtgccatgaaccacatccacataagacagcaaacaatcattaaatgtcatgtgttctgtttcagcattcctatctctctccctttcctccggcttccctgttccctgacacatagcaatattaaaattagttcaattagtaacccattcccatccctaatgttccagtaaaggaagagttgtgcatttctcactttaaatcagaagctgaaatgattaagcttagtgaggagggcatgttgaaagccaagacaggccaaaagctaagcctcttgcactaaatacttagccaagttgtgaatgcaaagtaaacgttcttgaaggaaatcgaatgtactactccagtgaacacacgaatgataagaaaacaaaacagccttattgcaaatatagaaaaagttttagtgattgagatagaagatcaaaccagccacaacatttccttaagccaaagcctaatctagagcaaggccataactctccgattatatgaaggctgagaggtgaagaagctgaaaaaaaagttcaaagctggcagacggtactccatgaggttgaaggaaataagccattgccataagataaaagtgcaaggtgaaacagcaagtgccgatgctgaagatgcagcaagttattcagaagatctagctaagatcattgataagagtggttacattaaaaaacagattttcaatgtaggtctaacagccttctactagaagaatatattatagctagaaaggagaaaacaatgcctaggttcaaagcttcaaagaataggctgactctcttgttaggggagaatgcagttggtgactttaaattgaagcaaatgcttatttatcattcagaaaatcttagaattatattattattcagaaaattaaacaaaaattatattatttaattattcagaaaatctcttatggattatactaaatctactctgcctgtgctctataaatagaacaaagcctggatgacagcatatctgtttacagtgtggtttattaaatattttaggcccattcttgatacctacagctcaggaaaaaaaaaaaaaagatttctttcaaaatatcactgcctattgacaatgtgcctggtcactcaagagttctaacagagatgtacaagggcgttcatgttattttcatgtctgctaaccctatccattctgtagcctatgggccaaagagtaatttcaacttttaagtcttattatttaataaatacattttataagactatagctgccatagatagtgagtcctctgatgggtctgggcaaagtaaattgaaaacttctggaaaggattcaccattctatatgttattagaccattaatgatttgtgggaggagggcaatatacaaacattaataggaaattggaatgagttgattccaactctcgtggatgaccatgaggggtttaagacctcagtgaggaaaagaactgcagatgtgggggaaatagcaagagaattagaattagaggtggagcctaaaattgtgactaatttgctgtaatcttgtggtaacttgaatgtatgaggagttgcttctgattgataacctgagaaagtgggttcttgagatggaatcttctcctggtcaagatgttatgaacattattgaaatgacagcaaaggatttagaatattacataagtttagttgataaagcagagtcatgctggagagtggtgctaccaaaggcattatcataaagactttgaaaagaggaaagttgagttgaattgccccaaaggtaaatatagatgaaaagaaggggaatttaggaaaattttttcaggaaattgtcattttttcctttaaagctgtgaagtgtaaacttcaaatttctgagtataaacatggttagaaggcatgaaaaataagtccggcctattgcctgacacatagtagtcccttaacaagctgataagtctatgaacatgttaccttttgtggtcaaaactaaaaatctgtttatgttgttattattattttttaatgtgcctttcttggcaggcaaatagttaagtcttaatttctttgtttccatccaggcctcttatgtgaggagctgaagaggaattaaaatatacaggatgaaaagatggcaatgttgcctcccccaggacctcagagctttgtccacttcacaaaacagtctcttgccctcattgaacaacgcattgctgaaagaaaatcaaaggaacccaaagaagaaaagaaagacgacgatgacgaagccccaaagccaagcagcgacttggaagctggcaaacagctgcccttcatctatggggacattcctcccggcatggtgtcagagcccctggaggacctggacccctactatgcagacaaaaaagtgagtttattttgacttcagtggtcggtttctgttgacttccttctgtataaaaattattttaaattgagattagtgaaatttagtgaataactatatcatgatgagaatgttaaattaaatatatatagaggatattcagaatatgtactttttcaaattttacattgaaactggttctggcattggcatactacttttaatttttttttacatctttcaaaattgtttagtataatgtttagtataacatagtatacattgtttagtataattgtttagcataacttttttggacatgacacagtaatctgccaaattttatagtcatacctattttttcctgctaataattaactctcgtgtgtatgcagacccaaaaatcacttaaacgtttttaatgcaaatgaaaattgctaatttcaattttaaaacaccaacctaattctttttattaaaatttcaaatacaaggtaacttgatcttgccaaaacaatgtagtaggttgtgatttttcatgttagctcggatgacctctggtttataaagtctccctggtaattttgacagtcatgtgaccctgttccctcttcactctcattcttccccgtttatatatttctgtatgatatctgtcacatcttgccttaagtagagttactttgttcttttcatttttctaggaagtaccttgaataaaaaactcatgccatatttttgttcaaactccttttcattacctgttatgatatagtttctcactaaatatgtattagttccttttttttttttttttttggagacagagtctcgctctgtcgcccaggctggagtgcagtggcgatcttggctcactttaagctgcgcctcccgggttcacgccattctccggcctcagcctcccaagtagctgggactacaggggcccaccaccacgcccggttaattttgtttttgtatttttagtagagacggggtttcaccatgtcagccaggatggtctggatctcctgaccttgggatctgcccgcctcggcctcccaaagtgctaggattacaggcgtgagccaccgcgcccggccgtattcgtccatttttacactgctataaagaactacctgagactgtgtaatttacaaagaaaagagatttaatttgctcacagttctgaatggcagaggaggcctcaggaaacctacaatcatgttttaaggcaaaggggaagcaaggcacatcttatatggttcaggagagaaagaggaaggaagtgccacacttttaaacccatcaggtctggtgagaactcactcactatcctgagaacagcactggggaaaccgcccccatgatccaatctcttccccccaggcccctcccctgacacgtggggattacaattcaaaatgagatttgggcggggacacagagccaaatcatgtaaatacaattgcagaaagaatggatgaataattttttaaaaatacagtgtactgagatttaagacaaaaagggttgtacttgaggactaggtattaattttaaaataattttcgatgtaaaagtgaattttacattaaattgtatttagatataactgatatagtgaaagggaacaaggaaataaaaagatacctgaaaataatagactctggtttgttttcttgagagaatactgccacattcaaataaaaagcctgactcacaaacttacctcccgaatacagtgagaaatgcttattgcctgaaacctactgataaccctatataaaacttagaaaatcagtgtttctcagataacacaagtcatctccctgccaatgggagaaaaatgaggcagggatttgaactttgtctttctgatttctaagccaatgctttaggttgttttaatattttgtggttactgctatttgtttttatttcttaactgaatactaaagctatggaaaaggacacttgttatggaatggctacaataacatttcaagaatatttgcttctattcatgtcattttttaaattaccatggttagtaagtgaggaatccccttaatttaagtcccttttaagagctaatattagtattataactaaaataaagaaattgaactcagtgattggaaggatttcttccaactctgacattccttaaacttaggaaaatattttttgaaagaactcatattttggaacacgtgctgctaaccatgacaattgccagcaagtattaaaattctcaaggttttatgataaaaatgatagagatagctagtttctatttgtctttcttaaaatgcaatgtaatggaagggaaagaagttgtgctttaaaataacttcaatagccacagttattgttactgttgaaagaaagtgaaaaatataaaatacagtattttgaaagttctaagtaatacatgctaacaaatagctcaatttttaaatttactatgaagaaatggacttggaattcattggccgaggtgacattgatagaccattgatgacattggaaccacattgctggtctgatggcagtgtttcttcaatatcacactgccatgtagaaaggtaaactgctgatattgatgtgaaaaattgatgttttggattctcaatttcatcctgttttctttttctgcagactttcatagtattgaacaaagggaaaacaatcttccgtttcaatgccacacctgctttatatatgctttctcctttcagtcctctaagaagaatatctattaagattttagtacactcatatccttttcaaaatgattacatccagtgttacttcatgatgtgatttttgcgattttattcaaatatagatgttacaccttttgcaccttgaaagactctggttttagtttattaatttcaatattattaatataatttgtcatgggtctcaaagaagactgggagagtggaaatattaagattttaggatatgttactcttatttattactctcttgttcaaagagacaaaatagtctacaagctcatttagaatttttttccaaggaaaagttgtaagcatttcaacaagtgtcatcctcaaatatttcaaattcacactgtcatctctttttttccttgattctaagctaccttattcagcatgctcatcatgtgcactattctgacaaactgcatatttatgaccatgagtaacccaccggactggaccaaaaatgtcgagtaagtcggtataagtacattttaatatagttttcgtattatcatttcatcctttccttttcctgctaggaagttattgcatttataaagatggggaatctttatcttcccatgttatatgcttgcttttctttcattctttatctcctctatggtattaacctgccagattagaaaaattagatgctgcagtgttttctagaagaatgaacttgtcagatgctccatcctgttcttaaacatgttacatatattttattcttgggtgtatgttttataattatatggatgtatttttaaataattgttttggtgaatttttgatagaagcaatgtaggaattttttaggcaggtctgagacctatattcttagttatttcaagtacctcttctttctgggagtgtttctgatactgacattttaacattttctggatagacctattatagtttaatagggtgtgtccgtaaaccaacagccagcctccaatatgtgtcttccattggttaattagagaaaatcaattataaggatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaatggcaaacttatgaaaatctcagacagcacagtgttccaataagagcaaacatcagggtttgctccaacatggaatgtctatacttaaaggaaactggaaactatatgaaagctagtcattgataggcaaatactaaatttttcaaaaagactatctcccacgcagaggtatgtgacatcattaagattgatcatcctcctccatgctcagcacttggatggatagtctatgcagagacaattaggtttacactttttccaagttcttgtttaaaaatgaataaaacctgtaagaagcacacaaaaaactcaggcctttaaatacaagtacagtgctttttatattagccggcattattcaattatttgatatttttgtattaaaatgtaaaagtatatatttgtaaaagagctgtcactgcttactaagcctaagattaatgcattgtatgtacattacatatgcattcagtttattttcaaggaaaatattacattacaatataattttaatttattcataattgttcctcttttcccaaatgtgtttatcagaaaaaattgatttttacaatctcaaacctagatatgctattttccgttaatgactttgaattatcaaagtagtccaggttcattggagccacctagacaatacagaaggatcttaagatttttaatatctgattccctcacccctgcctaacctgtatcaggctccctccttttgaggtcacatatgatggggcagtttcatctgctacctgctgctaagaaaacattgtgcaaagaaagctacctcttctcacaggtctcctttttttcctattgatacaattgaaatactataaaattcacaattttaaagtatacaattcagtgtttttcagtatattgacaaacttgtgtgacatcaacactatctaattcgagaagtttcataaccctaaatagaaactctgtactcatcagcagtcacttcaatttccttctctccctggtcccttggaaaccactcacctatgttttatctctatggatttgtctatttggatttttttatgaatggaaatatgaaacagtatgcagacttttgtgtctgacacttagcatactattttcaatgttttataagaaattaaaaatctaaattaccataatgtcaagggtctaacaattgaagcatttaattgtttatttatgcatttaagtgtatgaatccaccttaataatatataatatctgtattttgtttgcatcagatgagtcaaatcaatgctaattaaattaaattagttatgatagaaaaaaagacttgcagaactatacatttaaaaaaaagtcccaaacgtagaaaataccttgactaaaggctcaggtaagtatcacagactctatctgaattctgaataactctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtgttgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaacctttctttaagaaattttaattaaatttgatttcttctgttttccacaatcattatcaaaagtcagcctttgagtttaatcaattgcatgggtcttttaggatgaagatgactacttggctcacatctcaacttgaaatcttccctcctgtctgaggccttattttttcatttgcttacacagaaaggaaaatttcaattcattttaattgattttaaaatacttaagaaagagatcataaatatcagcatggggatattgcatgacattgttttttattttttctcagcaaaccatttctttattgaaaattattgcaaggtgtcactatatgctgcaatttgttttggtgctatttatagagaagtggtttgtttgacaagcattagaacttataaaaattatttttaaaagtggtttgaatagccgaattgttcattttgaaaacctgggtattctctgagaatatgttactatttttaagtatttgctgtaatatataaaaacaaaatatatgtaaaatagcaaacccagaaggctttttttgaattaagttacttaaggtcattgatttgatataatgcatgcctttctaggaaagcttgtgcttttgtttcaattcagaggctttatgtcattacgaacgcctttttctcccattttcaggcctgaagacaattgtgggggctttgatccagtcagtgaagaagctttctgacgtcatgatcctgactgtgttctgtctgagtgtgtttgcactaattggactacagctgttcatgggaaacctgaagcataaatgtgttcagaattcacttgtaaataatgaaacattagaaagcataatgaataccctagagagtgaagaagactttagaagtaagaatgtcctgcatttgttcgtaggttgaaataatgctgaaaacattgctctcttttaacaataaaatgttgctttcattttaatcatttcaaagctattcagatatatagaaagttgctgcagtgtaaatttggatcatgttatttatggttttcataaatcatcctggttctaagctatctagcagtactggcaaaaggaacatgggatagtgccataattcccaatttctatatcataaaaaagaatcagttttctctagagaaataaatgtagccttgaattaacattaaccattacatttaacaatgtgatagattatatattttatataattttatgatatagtacatacttatatatagtgacatattataaatttttatacttaatagatcgtactcatgactataacatcttacagttttattaatcatatacaatgataatattaattatcaaatattaaaatagcatctgtatcttgatagtattcctaaagatttgtacaaagcaaaatcatttactcggctttatcaacatccactttgtaacaaatgatgagtttcatagctgtttttaatggcttccttcaatataggctgacggcaatacatcaaagtttagtacagtagaattatttctgtaggtaccacatgagataatctgtatgcactctcagaagtctgcttacttcagaagtatcaatcagagtttcttacataaagcatgaattgaatgttctcttaaacaattatcccctagcatggtgtctctcactgtaaccattgatgaatattggatgaaaataagatcaagattgtactttctgtctgacacctggaatgtatctatctgatgttgccctcatgaatacataaaccttaatagataatttgacccaggtgtgatatggaagtcatgaaacctttcaaatatatgtgctgttcccaaaaggagatgagggaggaaaggtcaggattctccttagataataaaaagtaatatacatatttttcttattttaccaaatgtgtcctttctcactcactgtgataaataaaatccagtaacacttaaccaacatagtaaaagactataagtaaaacgacagaaaaaaatagaagccttaagaagaatactgaaagttttgaagtaaaatatttaacatatatatttttactaccaccatttgatgaggaatttagcatattttcccctcctttttatctttacccacttttccagtttctgattgttacaaatatgatttgaattttatttccaatttatggagaattttatttcttaatttatatgctgtaaaattaagatatctgataagtaacttacatttaatatcgtggattattttaccacacttatttaaacttaacttttctcactaggatcagtccttttattccgaatcttgctcctatttctgactttatactatgaatggttttcttaacctttattaaaagaaaatttttcaacaaattaaatttagcagcttatttcagcaagaaatgctatttcagcaagaaattctatttcttgctgaaataagataatagtaatgattcaggcagcattcggaaccaagagaagtttggagagctcaactcagcaacatgagcaggggtatttatagatagtaaaagggagtgacacacagaaacagcttgattgcttatagcttgacatttgccttatgtggacattgtctgataagtcagcaagctgtggttggctgaagctcagctgctgtgattggctgagacagttacttgtcataagaatatactaataaattagaatgcagtttgtttacatatgaagttagattgcagttctctatgtacagagacagcctttaatcaaatttaatttagttcatcactttctggaattgcttcatgtatatttttttcctaaaaagattaggaggagcccttgagttatgcgaattatttttatattgtgtttaaacatgaataaatgacaattagctaataatgaatcttataccacaatcctctcttccaaatctgtacattattctttattatcttctaaaatgtagttttagcaaagaggtgtttaaatcaagtctgaattttactttctgttttctatgttatagaagcctttcttgactgcataattgattcaaactttcgtttattggtgtgtttattacatggtttccctgtgctatagcaagaaacaatagcctcagcccttgctttcacagagcttaccatctagtgggaatgaaaaaatgtttgagggaacagacaaataaattaaaagtatctcaagttataataaatgccatgcaaaggaagtgagtctcaggtgctgagatatcaactagatgagaagacatctctgaggtgatggcatttaagctgagatctaaaagatagtaagaagccataaaatagtgtaagtgtgggtgtgagtctatgtgtggagggtgctgcttcagttaggaggaatagcatggccaaaggtcctgaataaagggagggtatgagtttaaagaatggaaaagcagcagcatagtttattaagagaaaggaagaatagcaacagagaaagtagcagaaaaacaggagtcatatcgtgcaggacatttcagcccatggaaaagagcttgtattttattttaaatgcagtagtttttattgctgtctgtcttgtggacaactgattgagcaagggtagatggtagatgggaataagaaagacaagttgaaggtggcttctctcatctaggcaagagaaaataaaggtttcattttctctgatggcagagaaatgaaggaaaaaaagatgagctcgacacacaaagtctgtagagcttgctgatggattaaagaagacaggaagcatcgaggatgacttctcagtttctggctgcaataactggatgggtggtgatggttaaggaggaaatggtggacacgtttgtagaggaaggtcactattagctagctaaaattaaaattagatgccttcgagatgtccaggtggatatataatatagagaattggagatttaagcatagaaatccgagggtctgctgagtttggagataaattccagagcaatcagcaaaaagaaaagacacacacatactcacacacacgtccctctagctctgaacatccctgatgtttttaagtgggtagagaatgggagacttggtatttaaagcaatctggtcctgagatctacaactctgacatttagaattcaggtagaaaagaggacccagaaaagaacacagagaaagagctgccaataaagtaagaagcaaagatataaataatgaagccaagagaagaaaatatattgtagaaacagatgtgcttgtgtggagtcatgctgcaagatcaaggattaaggatgatgaagaaagaaatacgcattaggttaagtaacagggaagtcatcagagaatttcttgagaaaatttggggaagtggtaagggttcaaggtcagaataaggtgcatacaggggtgaaaataagaggtcagaaagaaggtaatatgtgtagacaattctcccaagaaatctggatataaagggaagcagaataatggggcaatggctggcatttttttttaaaatacagatttttgtagggatgttttgctagtgatcatgaatgagtagttatatatgagtcaattcaggagagagagggagaagtcaagtcctcgtgaaagtgaaagagtaaaagagagagacagctccactaaaacaggaggaaagacagaagggaagactgcagagttatcaaaagatgattgagttcaaacccaatggtttttatttcctcaaagtataagatgggatcattgcctgagtgtgcaaatgaggaagagaaaattctacagaatatttgacaagaatgcattatatatatggtcatctcagggaatgagaaattcagtgtattttgagtgcaaatttgatgttttgagattacttaaaatataaccattcatttggttgtgagaggttctccaccaacattcagccatttggtagccagcatggaaaagacagatgctagattatgtgtagattgtggttctgtcaggttagggactgatgataatgaatgcccatggatttaagctatataaagagtgacaagaacctgagttggttgatagatcatgagaaagtactaaggcaaatgaattggcaatctttaaaagatcaaagaattataattgtaaaggcaacctacatagagaacctgagcataatctaaaagcattttctggtgcctatagcaaagtattttccgaaatgtctttcaaaattcaccatcaaataaattaactcactgtctcatctcctgctgaaaaacatacaatttgtagatttcctttggtgttgctatctactttgatgctcatcaaacactcttttatgctgctacacatgaaaatggggttcatgtgcacagtgtgtagctaaatgtgcggtattatggagaaatatactgtggttatattgggctaaaataggatattctcttcctcctatttttctaatatttgacatttaatagagaaagttttgaaaaaaacacaatgttggtcttcactgctaacaggacttttcctatcttcttcatctacagctgctttcttgtgagaaccacatttgccagagcgtagagtatcatgtgcaggccctctgcccagacctgatcccttgcactagttttctcagagttgcattatttgcccttggttgggcaaataagcccaagccatacacaattgtcataagttgtctttttttccattttgctacattaatcttgaaaattaataaaaaaaaattcacctagaatcttcattagatttaatatcaattctatatttttgttatatcaattttcattctcgccatatgtattttagtgggaagttggcatttatttacccccacccacaacctttgccattattctgcattcccttttaaaactaggtttattgaggaataatttacatgccacaaaattcctctttttaaacgtgtacaactctttttttttaaaactatattcagagttgtgcaacgatcaccactatctaattttaaatattttcatctttcccattaagaaaccctgggcccattagtagtcattccccatttcccttttcccccagtccctggcaaccactatctactttctttccctatggatttacccactctgtagatttaacataaatggaatcatataacatgtggctttttgtgactgtcttctttcacctagcataatgttttcaaaatgtatccatggtatagtatgtatctatgcttcatttttttattgctaaatgatatttcattgtatgtatatgccatattttgtttatacattcatcagttgatggacatttgggttatttccatcttttggttgtaattgtaatgaataatgttgctgtaaacattcatgtacaagtttttgtagaaatacattttcagttctcagtatatacctagtaagtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaggcgcgcaccaccacacccagctagttttttgtatttatagtagagacagggtttcaccatgttagccaggaatggtctcgatctcctgacctcgtgatctgcccgcctcggcctcccaaagtgctgggattacagacgtgagccaccgcgcccgacctttttttttttttttttttttttgagacaggatctcactctgtcacccaggctggggttcagtggtgcgatctcggcttactgcagcttccacctcccaggttcaaacaattctcccacttcaccctcccgagtagctgggactacaggagcccgccaccatgcccggctaattttttgtatttttagtagagacggggtttcaccgtgttagccaggatggtctcgatctcctgacctcgtgatccacccgcctcggcctcccaaagtgctgggattacaggcgtgagccatggcgcccggccatgattcattctttatctttcagaatcatcccacttttgaatgtgcacaagcaatatttcattctttgcattcattttttccctttttaaaagacattaaccttaaatcttcttgaagccaaccatcttaataatttaatgtctagttgtttagaaattattgtaaagttttctagaaacctagagtgaactacttgcattgctttacctttcatcattcttgtactgtgttaaatacagtagtgcagcagtgtgctaatacagacagctccagagcccattcatataatttggctcctcagtggttgataaacatgaaccagagttagtttaaaggataatcctaaagtaatccatccttaataaaatacttcggatgtttatgtatgcaaaattgcatcttatcctcccccatactcactctaccaggcccatccttcccaaggttcaggagtgttttcaggaaagcttttcatgcacattttcacctacatttgcacctcaaactatgatcctttattgttttatctgtgtcttctaagtaagataaaatgatgatgtgtaagtcaatcaatagtattatctcaaattgtatactagtttaattataataactcccgtttttgagcagctagtacagaaagtgtggatcacagtatcaagtggtttacatgcaatatcctatttatactatttaacaactttataaagtaggtattcttatacatattttacagatgcagcagctaaggcttaatggcttaaagataattcacttacttaagaagggatagaagcaacattcaaatccaagaatatctgatttcatagtctttcttccatgattactccaaaagtctcctaataatcagattttttatttgacctgagcaaaataggaagtcaagttcttattaagtagaatagatatttaagagagatgacaaaaggtgttttagtcacttaaacgtttactatacaaggatagatctacctgatgtaaatgacgagttgatgggtgcagcacaccaacatgtgcaacatataatttgcacaagtatacatatgtaacaaacctacaggttgtgcacatgtaccctagaacttagtataataataattaaaaaaaaggatagatctgcctccagtcttagcaacaagccttaacagcaaatgacagaagagttgatgagaacttttactactaaaaattagcacaaagggtaacatgaaaggtgaaaaatggaaaatatacattgattacattgtcatctcctcaacacctagaattagtaggtcctaaataagtatggactggtgaatgaaaagtaagagaagttcagaaaacaaattttattcatttatatactgccttactgagtctgcctcttatggagtattttgggactcagtcaggggctctcttcctgctcttccctttccctcaactcccatttcctcctcttccctccctacccccttccttctcctctattcccctattttcccttctcttcccttccttttccttttctagctacaaactttctctccaggtaaattcatcaatcctcatggccttgatagttgtctattagatgataactctcatctttatatttccagccttgatagctctactgatgtccagaatctcatatcaacccagctgcttacttgaaaaatgtaatacccaacaatcatcccaaacaaagcatggctgaaacagaactcctggtttttctccagacctcctcttgctgcagttttcctctactcagcaataggcactaacaactccccggctgatagatcctgtgtcttctcttttgcacacaccctgcatgctctccatcagaggttcctgtccattctcctttcatccccttctctctacgtccacagctattctctgagttgtagccatgtcctgtctcactattgtcacctaactggtctccttgcctccacacctgcttctctatagcccactgcccacagagtaaccacagtgacatttttaaatgtcagtaatatcccatatttctatttcccacttctattacattgatgtaccacataacaatgttttagtcaatagtggaccacatatataatgatgatctcataagattctaatactgtattttttactgtaccttttctgtgtttagatacacactttccgttgtataacagttgcctacagtattgagtacagtagcccactctacaggtttgcagcccaggaacaataggctataccacatagcctaggtttatggtagcctataccatctaggtttgtataagtgcaccctaggaggtttgcacaaggatgaaacgtcctaatgatgcatttctcagattgtatcacagtcattatgtgacacctgactgtacctttaatcatacttaaaatccaaactcatttcaatgatatgcaaattctgacatgatctggcccctgcctacctctgccatcacaatcctccctctcaccacactgtagccacgctacactgtagccacatcttgctgggttttccacataccaacttcatctctgccttaggactttagctcttgctcttcccccagcccaaatagctcttcaccagtcttttcatggctgtcttccttgtcacatttagatcttagtttaaatatcatctccttagaaagaccttccctgacttcagcctaccacattgccttaatttattttctttagatcatttattactatctgaaaatatcttgtatatttatttatttacttaagtttttatccaaccacaacctccaccctcacctaaacataaaggaggcctcataaaactaatgattttattcatcatgtttattgtcatatttattgcctagcctataagatattagaaataaatatttgagggagaatatatgagaaaatagtaaacaaatggatgcatgttgcctggttccaggcctgaatttctagataattgtctatatcaattgatttgcctgctttatcataatcacagattaaactctgtaatgttataactgttcacattcttcttcaacagaatacttttattacttggagggatccaaagatgctctcctttgtggtttcagcacagattcagggtatgtaatatttgttttctctttagtctaaaggctgaaagagaaagaaaagaatgttcaatcagtttgcaaattagtctttgattctatattgctttttatatatttcatggttttatttgtctcattctgtcccacaacaaatccagtctttaaaatgttcacagttaatgcatactcttgaaagcaagactttgaaatagtgtttgaattaacacaagagagaagtcacataaatcttaagaaggtagaaaatgttacttctagaaaacaccaaaagttggttggatagtttcaggtctttcttctttctggaaaaagaagagtcacaaaatcaatttttctttctactcccaagttccactcattctccaattaaatgtgactcataggtgactgaatgttgtgttttggcaactctaagcaaaggtattccttggacttgggtacatatattttaaaaatattgtatatataagaatattgtatatatccaactgtccatattgctgcttctctcttacaccaacttcattttgtagcgttagctgcattagctctcgcttttccccctatgcagatatctcttcatcagtctctgtgtacactggaaacataggaataaaccggataaggttgctgttcccagaagaatctcagagtattgtgtttatttaatggcatcaggaaaaaccagtccaccaattttagaaagaaaaaagtcttaaagctacaaatttttatgaacttagataattactatattttgactattattgattctaatccattccaagaattatacagaaagaaagagctttggtagcagcctacgtatcaatatttactgatccaagaactattacaaaacgtctattgaaagtttccatgttttaatgatgataatgctaatggcagctatggtttattaaatactttctatgtgcaggaagtaagctaagtaatttgtacacattatcttatttaaacttattacaaatcttattttcttgaggtagatgttattatcctattttcacagacagacttgtgccttgaagaatttggtaaagtcactataagtagtcagtagtagagtgtgattcaaaaccagttcgtcctggctccaaatcatgtattcttaatcattattcaatgttgtccccctatagaagaaaccttgaatttgtaacttttcactacggctatttagcttgtgtcctgaagacactctcacctataatgttctttttcatgtgtagccaatgtccagaggggtacacctgtatgaaaattggcagaaaccctgattatggctacacgagctttgacactttcagctgggccttcttagccttgtttaggctaatgacccaagattactgggaaaacctctaccaacaggtgagtgccaagagaaacatgcattgtatttttgaatggcatatgtatctggtgtatgttaatagcctatattaggaggatttttatttatttgagaatggaggaaactctattatcttattactaaaattataagtgttttactctcataactaataatatggatagttcttgaatcgtaaataattttcttatcttctctgggcatatttaatctctagatctttccccttcctgagtatattatcccatggggtcctagttaagtaccgggacatactgcaatgttttctcaagctgctcctgcacatgtactgttttccatgcatgcttgggatggcctgaagagaagaggctctctgatgttcacctgctcaccatgttttatttttgaactcctatttacagttaaagattcaattcatttctttaagtttttctctcccaaatcaactgctcccaactgtagatttccatgactttttgtatattcttctgtttatatcattgatctctcgtactgtaagtgttaattcacatggccattttctctaacttgaatgtgaacctgttggggctgtggtctctatttacttgtatattctcagcagccaacccaaaaggaaggagagcaaaatgattattctatattatgcataacaatgatacacttttatcagaatagttgcagatttgtcttttttttcttttttggcctattttatatttctttatttccaagaatattataaatgaattcagaaattatgtaagatgcactttacagcaaaaacgggatgcaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggcaacaagtggtcacctttactcaaaattaaagaaacacaagtaaaaaaattaaaataatttttcatcagaggtaagacttatttttcatttaatatctgtttataatattctaaattcactttaaaatgctttgtatgataaaagtatattatattatacaattattaatataaatgctaattatcttgtaaatttgtttaagttacttatagattctcaatattagacctttgtcagatgggtagattgccaaatttttctcccattctatagtttgcctgtttactctgatgttagtttcttttgctgtgcagaagctctttagtttagttatatcccatttgtcagttttggctttggttgcaattgcttttggagtttttgtcatgaagtctttgcccatgcctatttcctgaatggtattgtctaggttttcttctagggtttttatggtttggggttttacatttaagtctttaatccatcttgagttaatttttgtataaggtgtaaggaaggagcccagtttcagttttctgtgtatggctaaccagtttccccggcaccatttattaaatagggaatcctttccacattgcttgtttttgtcaggcttgttgaagatcagatgcttgtagaagtgtggtgttgtttctgaggtctccgttctattccattggcctatatgtctgttttggtagctgtacatgttgttttggttactgtaaccttatagtatagtttgaagtcaggtagggtgatgcctccagctttgttctttttgcttagaattgtcttggctatatgtgctctttcctggtttcatatgaaatttaaagtagtttttttctaattctgtgaagatgtcaatgatatttttgatgggaacagcattgaatctataaattactttcagcagtacggccattttcatgataatgagtcttcctatccatgagtatggaatgtttttccatttgtttgtgtcctatcctgtttctttgattagtggcttgcagttcttcttgaagaggtctttcataacctttgtaagctgtattcctaggtattttattctctttatagcaattgtgaatgggagttcattcatgattttgctctctgcttgtctattgatggtatataggaatgcttgtgatttttgcacattgattttgtatcctgagaccttgctgaagttgcttatcagtttaaagagtttgggggctgagatgattgggttttctaaatatagaatcatgtcatttgcagagacaatttgacttcctgtcttcctattcgaataccctttatttctttctcttgtctgattgctctggccagaaattccaacactatgctgaataggagtggtgagagagggcatccttgtcttgtgccagtttttaaagggaatgtttccagctttttccgattcagtatgatattggctatggatttttcataaatagctcttattattttgagatgtgtttcatcaatacctactttattgatagtttttaacgtgaatggatgttaaatttcactgaagaccttttctgcatctattgagataatcatgtggtttttgtcattggttctgtttatgtgatggattacatttattgatttgcatatattgaaccagcctctcatcccatcaaaaagtgggcaaaggatatgaacagacacttctcaaaagaagatatttatgtggccaaaaaacatgaaaaaaagctcaacatcggtgatcattaagaaatgcaaaccaaaaccacagtgagctaccatctcaagtcagtcagaatggtgttgttaaaaagtcaagaaacaatagatgctggtgaggctgtgaagaaatagtagtgcttttacactgttggtggaagtgtaaattagttcaacagttttgaagacagtggggcaattcctcaaggacctagaaccggaaatatcatttgacctagcaatcccattactgggtatatacccaaatgaatataaatcattctactacaaagacacatgcacatgtatgtttattgcagtactatttgcaatagcaaagagatggactcaacccaaatgcccatcaatgttaaactgtataaagaaaatgtggtacacatacaccatggaatactatgcagccataaaaaaagaatgagatcatgtcctttgcagggacacggatgaagctggaagccatcatcctcagcaaactaaaacaggaagagaaaaccaaacactgcctgttttcactcataagtgggagttgaaaaatttgaacacatggacacagggaggggaaaaacacacactagggcctgtcggggggtgggaggcaaggggagggagaacattaggacaactacctaatgtatgcaggtcttaaaacctagataatgtgttgataggtgcagcaaaccgctatagcacatgtatacctatgtaacaaacctgcatgttctgcacatgtatcccggaacttaaagtaaacatgtgaagaaaagctcatcatcattggccattagagaaatgcaattcaaaaccacaatgagataccatctcatgccagttagaatggtgatcattaaaaagtcaggaaaaaacagatgctggagaagatgtggagaaataggaatgcttttaaactgttggtgggagtgtaaattagttcaaccattgtggaagacaatgtggcagttcctcaaggatctagaactagaaataccatttgacccagcaatcccattactgggtatatacccaaaagattatatatcattctactgtatagacacatgcacacgtatgtttattgtggcactattcacaatagcgaagacttggaaccaacccaaatgtccatcaaagatagactagataaagaaaatgtggcacatatacaccatggaatactatgcagccatagaaaagaataagttcatgtcctttgcagggacatggatgaagctagaaaccatcattctcagcaaactaaaacaggaacagaaaaccaaacaccgcatgttctcactcataagtgagaattgggtaatataacagatggtcacagggagaggatcatcacacactggggcctgtcggggttggggggtaaggggaggaatagcattaggagacataactaatgtaggtaacgggttaatgggtgcagcaacccaccatggcacatgtaacatgtaacatgtaacaaacctgcacgttatgccaaaaaaaaaaaaagaaaagaaaagaaaaatctctgtaccttcagtttaattttgctctaatcctaaaactattttgaaaaatcaaatctattttaaaaagcaaagaaaaccaaaaaaagttaattgaaacacctatgagatgaataaagtaattaaataagactatctccctagagttaacattcaatgatattattagcatttgatggtaaagaaagaaaagatagaattttaacagtaagagggactatagatatcacctgttcctaaaatttgaaagtgagcaaaggatttgattttatgagtaattttcaggctgtaggaaaaaatgcatgatttttatactactacacttaataatcaagaatcatacatgactttagtacaagcatattacattgctatattctttgtactgaaaatgtgtttaatatttgttttccatgaagatataatttctctttatatttttgataacatgagattatacaaaactgtcaaatttgcccatgccagtcaaattgaaataatttactaaaaaacttcctgttgttcaaatgacaatttccatttttccctagacgctgcgtgctgctggcaaaacatacatgatcttctttgtcgtagtgattttcctgggctccttttatctaataaacttgatcttggctgtggttgccatggcttatgaagaacagaaccaggcaaacattgaagaagctaaacagaaagaattagaatttcaacagatgttagaccgacttaaaaaagagcaagaagaagctgaggtactgttatttgatttaaaattcttcccagaggtagaaatgcaaaaggttacaacagaggctctgtggtgtatgttcggccttctccagctagattttctttaatgaacttttgtgtataaactgcatcctcatttctggtgtggataaaggatccagttttggacggagctagaattgacactttccccataatcatctcactgcatggaaagtgatctaaggctgttcctcctaaaccttttacctacaatgacttagagtgtgtgtgtgtgtgtgtgtgtgtgtgtttatatatgcatatatatatatatatgtatatgtacacacactcaaaatggatttccccagagcaccaattgtatacagtggtttcaggaaacttattttaatgttaaaattaacaggtactgttctatggggtatgaataccacagtgcatcatgttttgttaatgtcacaaggatttttaagataaaacaggagatattaagaaaataataattttgatgtggctacttcaggttgtcacagatccttgaaagtttcctccttaatcctctctgcaaagagattcttcagtgtaaatgtttgagaaggcttgtacgaagagaaacataatttcaaatatactgcaggtgtcttaacatttgtctgaaggtttgacctagttaaatctcttcaaggaatctaatgtattaggggagggccatcatctgtaatgcagataaattctgatgcacaaatattcagtgcagtgtttgaataatggtaaaaatcagaaaacatttaaattttggaaaattagaaaataactaagaaaattatgaaaactgtgtatctcagagtattattttgccatagaactatgtgttttttaaaaattatgatgtcatgaggaaaaatcttttagaataatgatggattaaattctgtagtcagatacaatctcagttttaaaattatacagacatataaaaagaatggaagaaatatttgcaccaattatttctgggatgtaagatgactttttttctgtttttcatttgtatctttatttcccatgtttttacaagaatttttttagtgtttataaacaaaacatttttgtaaaaggatagtactgggttatcccaggtactacctagggaatccccagaagtttcattcaggccaatactcattgaccttaccactttcttacaatattgtgctgtaataattcatttatttttcagataactcaatctttattaaaccatagagtgcctgattctattgatgatatggagttaattgcctgatcatcaaattgtctgtcttattacatggtttatgtgagttttacgttccaaaattaccttgtaaaacattaacatataatatttaatttgtctttactgtaagcaaattaataacatgtgatagtttaattccaaaacacaatagagctttatttcaacctgagacaaaaaatatatatatactttgtaagcattctgatcactgtgtaaagaaaacgatcatttcatgtttaaaggacatgattatatgcatcatgttgttatgctgataggtgaaagatgtcctgtcctagggtttcctaggatttggaaatgactcatttaagtgttaacgtcttggcccaaccaggcaatcgcagcggcagcagctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaagaaaagggagatgctgagaaactgtccaaatcagactcagaggagaacatcagaagaaaaagtttccaccttggtgttgaagggcataggcgagcacacgaaaagaggttgtctacccccagtcaggtaccacccaaactgctcaatgtgtaccaccagaggcagaatgatagagaaaaatgtcttattttagggtaagagacctcaggagaggatagtgagtgacttcattggtatgattttaggtaaaaaccaagtatcgctgggcgttaatggaaagatgtacacaggttttcatttgggtttgatcatttttgaaagatcttatagtttcagaattgtcaaaatattttctaataaactaattttcagaaacaaaatattcctgagaaccattgtagaaataaagagactattcacactatagactagttgcgcttctttctttctttctttcttttttttttttttttttgagacggagtcttgctgtgtaacccaggctgcagtcggctcactgcaagctccgcctcccgggtttacgccattctcctacctcagcctcccaagtagctgggactacaggtgcctgccaccacgtccggctaattttttgtatttttagtagagacggaggtttcaccatgttagccaggatggtctcaatctcctgacctcgtgatctgccctcctcggcctcccaaagtgctgggattacaggcgtgagccaccatgcctggccttgcttctttcttaaccattatagttaatagtattacctgagtatcactcacccatttggaactttagagaagcctttgatatcctccacccccaaccacatcaactactaatatgtaatgccatagtccgttaattctgcttatgtggaagttctctttccctttctcttttcactggaaccttcatctctcaggtctccctgcctataattctgcacaaatccctaagaagaaccattgcttctattttccttaggacttccctgttttccatcacacaaccccacaaatcatttttgtaaactaaaaatctagttaagaatctgcaagattctgcctgatatacacaataataaaaggtagagtccctgccttcacaatttcacttgaacctaggcgatgatacggaacttggacacatatatcaataaaaataaatatgacaggagcagtccaagctggttttgaggcaaagaccttgccatactttttccattgttcacaatatttgccgctttgttctttacatagtaagcactaatgtctattgaactagatccttccaaaggctttgcatcctggacatgagtcatataagcatgaatttttcctcctctttcgtattaggcaactactttaaaaatatttaatgactataaattaactggtgttaaatggtctttttaaatacactctaactgagctcttagtacgtaaggtggattttcaatgcaaagaagcagacagcatgatttccagttttttgtgaagcttggggattgatatataaaaaagtgaatgaccggtaacaatactaagttctttttttaaatgatatattctgtgcagcaaaatgaatggcattaaaagaaaggagcagtaactctagaccagaatattagagagctgtacagcaacaaataatttacctggtcctgaaaggatgagttctgcaaatcatttcatcccttcagtggaataagttttttttctcactgaattgctttgtttttaagtgtgtttcttttaagtcagtacagagccacctgccctcaggccagtgggttcagtggtatttatatgaagtatacttctattagtaggtgcttcagcaaatacatgttattttgtaatttttctgcagtcaccactcagcattcgtggctccttgttttctgcaaggcgaagcagcagaacaagtctttttagtttcaaaggccgaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatactgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcggtctctctgctggagggccttctctctggtcttgtgaatggctctgcattttgcaatactttttctatagaaacacacctttgattcattaccttaatcctcattctatgtgttgtaggcatctaactcaaagataaaatcccatttttgtaaaaaggtacttgtctattaattttataattgaagattataaataatctatttagagaacaatttatgaaagataaatatatagatagatatcagcacagaaaatgcaatgataatgctgatattagttaataatagatcccatttctatgaagaaatttggattacttgccagctactgctatctttttcaggtcacagcttaatatgtacctattccaaggaatttcaagaaatcttatttgagttgttagtaacagcaaacacgtatttagtatttacgacaaccccatgagatgacatattattatctctgctttacaaatgggaaaattgaggcatggggaaataaagcaacttaccccaatgtacttaggtaataaacggtagctctgaagttgaaacagaggctgtctgtttcagagcttgtactcttagccacccactctgctatctctccaatgtgcagtagaacgcttaccttgaaaaaatttagaatgactatgtcttaggtcctctacataaatgaaacataactgttttcctttttaaaaaatatttcatcaggagtttgtgaatcaaaacaaaatatctgaaatgcaagcattgatacaaacaaacataaaagcaaaacaacaattttacagcagttccaaaggtctaggagtcactgagtggttagagaaaggtgtctgattaggcttgaaagtgagatctttctcattcctggagtttccaggatatctctttagcccactcactatgctatgctgcattactaatgtcagcaagggctttgactagcccaataagcttcaaacatatgctacatgcttatatatttatatttgcagacagtgtagtattttaaatgagaataaagttccatcaaatccatggccacacatatatttcaatttgaataaatgcatgtgcttttaggtaacatgtgacctcattgtgtgcatgatacagcttaagcccttctctcaaggtatttttccttattgaatgagcatgttaaatttctgtggaatctaactttggttgcattttgtttttcaattatgtgtgtagtatgtaaaatattatataatttatatcagatttggagattatttcacattttttaatgaagtttcttcatttaagagttttttaaccataaaaaatcagtatcacaataaatcctaaagtgaaaactagaaaactagggaaattagtggatacttataagatacaatcataatacaataaacataaaattgtggcacaatatatggtttatatgaaaacactgcataacaaataatgtcatctctatacctgaaacatatctacatggaaaagaatttgtttaatctgacaaattcttatttcagactatagcacagaaaacatggtttcaagacttttcaaaaagttgactttttacagagatctctcaaatgggtgtgtctgttcacatacacatatatgtataatacacccatgcacatatttatgcctgtatgtgttttgatacaccacatacatgtatgactatacctatacaactatacaacttcacaaatctagaaatagatatttatatatttaaatatatgtatttaaaatatataccacataccacacacaagcagacaaacatgatctagggttgtatagttttatgtgtatatatgtgtgtgtgagtatgtgtgtgtatttctggcctgcacggaatcaacatagtgttttaaatttgaattaattttcaagttttacaaataagacattttctcacaaaaataaatatacttggtatgcatgaattcatatttttgcatggcaacaatttctagagctgaaagagtggtcacctgtttcagatgtagcttgcattctccatttcactaattgttcttttcaaactgagtcattgatcatcatgtactctgctcagttcatgaggtctttcttggcagtaagagacaagcattacagtagtttcattaatgttgtttcctcaatacaaagtaattccagaaatttatcagagaacactgagattctacccctttagacagcactacagcactttaactgttttcatgtaggactctcacatgataaaactatctgaataaattggacacccagaaaggtagagaggtgatgatagtgatgtaacaaaaaagcagctagctttattatttatctcctaaatattaattcctttaatcctcacaagaatatgaagcaagtactatgattatccccattttaccaataataaaactgagacagttaagtaactctcctgtgatatacagccagtaagtagcggagccataatttgaacccagcaatctaagctctacttttaattactcaccacagctatataagcaagattttatcttatacctacaatttattaggattctgttcttaagacgttaattgatctttttttagggcacaaccaatcaaatacacaagaaaaggcgttgtagttcctatctcctttcagaggatatgctgaatgatcctaacctcagacagagagcaatgagtagagcaagcatattaacaaacactgtggaaggtatgtaataatcttctttttaccggatagattcttaaataaaattaacataaatctggtcaaccttaaatagacatgtgaaattcttagcaataattcagaggccataaaatagttttaaatgatggtaaagataaccaatggatattgatggaattggttttatgtgcttaaaaatggataaagttatttgctcttaaacacacacattgataacatggcaaaaatgactttgcaaaaatgaaaaagaaaaccacaaagacagatgttgggtgatctgacctttcaaagacaagtgatttgatggtaattgatgcagaaaacaaggttaacccagagctatgtgattttgtccctatccaatcttacaaattacatattcgctcaaatttgtctcttctaataagcaaagatagtcaaagggtgacaactttacaaactgttctggcttctaccctctcccctgacaatgtgccccaggtcccacctggtccctggtctaacacttcacccccacattcccatcatgggagcagacaaagtgtctacccatcccctgaatgaatgatgagaagtaaatgggctggctaatggtgtgaaatatctatttcatgagtcctccataaattatttctagttgcttggttctaggattgttttcacccatgaactattacagcaagagttttttctggatagaatagtctcgtcttattgttgtcatgggactaaaaacacaggtgaaaaatatgcatattggtggaaaatatacatttctctgttaaggaaacattagttctcctgtttaccatcacatgttaggtgcatttttctctgaaagatgcccacatatgtgcttgcagtcattaatttcacttccttaccctcacttatgcttcatctaggcaacaaacatgtcataatagacttacgtaagaggctatactttcattgaaaacaatactgttaaattttcaaaatctaaactacaaaccctgtttcaatattagagtgcctcactgatttgtatctggttaggagtgaaatatacaaatggctgactccatgttctctgtttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacatcacccaatgactgaggaattcaaaaatgtacttgctataggaaatttggtaagtctcttattgtgtgttgcatactcatagtttctctctttagttgtcatcactgtcatttcatatttttttatgtcagatgaaattgcagcctcataattatgcatatcaagaagttaccatatgaatggatgcgtagagccaaatttctggttatgtctttcaaaataattgcgcagtagtgttgaggtctataaataacaatactatttctataaaaggttaccatcttgggagttgataatgattttttcttccagcatatttcttgggagcaacacttaacatttttggttctttcttataccttcctaattacattgctgcttttttgtaagtacacatctcacatattttcagaaaacctgtggatgtattgctttgacataatagtggtgaagtgtttgggtcctcagagtcccaaagacctgtgtttgaatgctgattctgcattatatgagtgatatggccttggacaaatattttaactccatattatttaatttcatcatttataaaataaaacttcattataaaatgataatttttatttataatataattataactatatttcatttatcatattgttaggtggattagtttctacttattagccttgcatatagtaaatacacaataaattaaagctatcatcaccatcaacatcattatcatcaaaacttcaaaagcttaatgaaacaagctttaaaaacaactattttgagaaaccaaaatggttgaactggacatagaagtctcaaggataggtgagaaagtgatcaacaggcttctagaagatataagatccaattaggaaaactgatgccagagtgatctctaaaatgtacagtgttggtcacactaactcatagtaaacaaagggccagtttttgactatggatgtgaggcacgcaccagttcatttttagggctagagaatcccagcttatgactcttcgtaaaccatgaataactctgggtatctttgtcaatgtctacataagataattttgcttttgctgtggtcccaaacaaattgatatttgaagaccagaagttcttttctgggtctgctttctcttccaaattgtctacaaatattcccagttacaatgtttttccccatgtgctcactgagttggcattcttcttcccttctatttatctttggaaaaaggcaggaatatctagtttctaattgttggtggagatctggatcatgcaaataagtaccttctcactgagatgactacatccctgtgaactcagaaaggatttacctggtcacagctattaccacaacctcaagtccagctgctccctgccaatcgtcttgatcctgcattatttgaaaattgactcctacaattatagacctaaacatttcccttagaatcttctttgatcagattccttgagtcaaagtgtacccaaaggattcatttcggtgttgcctttttaagtgagtcctttgataccagtatcatgaattaatgatattttgcaatgcacttttgtgtcaaagctttagaagtcttactttagctgccatattgtcaattaaatacttttttctcatctgctgataaatctttaaagagtgagtcaacatgttctttattactctaacagtagtcagatcagaattttttttttttctggctcaaaatttcagtatcaatttatgttttctttttatcttcttccagaacaactttttgacccacataaattctttgaaaacagtgactgtgtcaattaccaaatgttttactttgctgaaattttaatatgctattctaaaacgctccgtaaaaatgatgagcactgacaggacagttagagcttcaaccttttgatacttatatgggtgccagggaagagtgatacctagtttataggactaagttgataagaatatccatttataaagtatttagcaaactgtctggaacacagtaaatgctaagcaaacagtgattattatcattgtgttgatttactattttctaatattaacagaaaaacattatatttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggactgtcagttctgcgatcattcagactggtaaacataaactaaggttgccattatattctataataaagggatatttatttggttttgcattattatttaaaactttttggaatttgaatcaaaaggcaagattatatcttgatatcaagtaaaataaaatccattcattgacaaatgcacttaaagaactgaaaccacttgaatatttttacaatttttgaggacatgctcaattctaatttgaagtacacactaatataaatattttctattatattcatatagtacaataatttatttcacagtaagaagcttatggcttacagaatttcaatgattatatgttcataactttatgaatttggtaaagatcaaattgttatccctcaaacaattgttgtctgatcttaacaatataaaaacaaatagagactttttaaagcacatttctctaatatgctagattttatctaaatgtcagcatgaaaaaatgtataaaagtattagaaaatagaattaaggataaattatcaattctaaaagaaataatatcacaaattataagagatttccatagcaatcctgaactaaaagtacatactttcttcataatatctgttgtcattttttggggcaagtagaacaaactaacagaaatattgaaaatagatgaaaatgaaaaataagaatagtttattttagccagataataatgacaatattataggacttaaagtcagctttaaactttgaacaaaatcaagattggaaacattgaaaaaattttcataatgattaatattaaactttatatttgcttttagctccgagtcttcaagttggcaaaatcctggccaacattgaacatgctgattaagatcattggtaactcggtaggggctctaggtaaccttaccttagtgttggccatcatcgtcttcatttttgctgtggtcggcatgcagctctttggtaagagctacaaagaatgtgtctgcaagatcaatgatgactgtacactcccacggtggcacatgaacgacttcttccactccttcctgattgtgttccgcgtgctgtgtggagagtggatagagaccatgtgggactgtatggaggttgctggtcaagctatgtgccttattgtttacatgatggtcatggtgattggaaacctggtggtatgtaaccagatgttcttacattttaatttctctgtggaaattattttgtgatgatgtgatctattatttttataattttataattatatctaaagtcattaattacaacagaatagtgataattttaattcaagaaagaacaggaaagagaacaaaatgttgttttagtttccctagccaaataatccatatttatatttttcaaaatcactgcctattcattttaatgcaaagctttctatctttctctctaatcttgatagtaatggcatatgctctcttgaagctatactaataaataatatataattaagttaataataacaaaaatgaagttaataatggaccaaggcaaatgaaaggactggtcccgcaccttatagccatgtataagactagcctctatagcaaggatcagcacctatgccccacagaccacagcaagtccagtgcctgttattgtgcggccctgggagctaagaatgatttttaaatttttaagtggttaaaataatcaaaagaagaataaatgacacatgcacattatatgaaattcaaattttagtgttcataaattttattcaaacatgggagtgttaattcatttacgtatcttccatggctgcttttacattacaatggcagagatgaatagctgccatggaaatcctatgtccaatagcatctaaaatatttatcatttggccctttacagaaaaagttttccaaccactggcctatagcatcgcgtagacatagcaatttgcctattttttgaattagtgttttcttgacttgtacttctttttatttttttcttccttatactgattggtgaacactttcaagcttacaagcaggagaaaattgggataagatgctcttctatgagccactcatctcaattctcaaatctgccgtgttgactagtctcagttggtcagcttgacatcaaatctctcatcaggtatccagaaggtggggtatggtaacagccatatggtaagtgccttcacttcccactgagttgaaaaaagttactaaaatattgttgtccttgtaaccgccataaaaaaaaggactcagaagtcaggacagaaacctacattcatccaatcacacactaaatgatactgtgccagacatacacaaaggcatttatgcagcacatattctggatttttactgcacaaaaaatatatatcatggattaccattctgtaattgttgatcaccctcaagttgcagtaataaatgagctttctagttttatacagccttacaaattccttccaatatggaatgaaatacacattctctttgtttcttcttctcagttttgcatttataagctcctatagcaggatttgcttgtgtattttttctttttttttttttttctttgagatggagtctcactttgttgcccaggctggagtgcaatgatgcaatctcggctcgccccaacctccgcctcccgggttcaataggttcacctgcctcagcctcctgagtagctgagattacaggtgcatggtaccgtgccagctaatttttgtatttttagtagaggtgggttttcatcatgttggccaggctggtctcgagctcctgacctcaggtgatccagcctccttggcttcccaatgtgctggaattagaagcatgagtcaccacgcccagccgtgtacttcttcttaaaaaattttgacattaaaaaaaaaaatttttttttgacataaaatcatgaaattgggacaggtataacttgtgaaaacatgccacatcaaagccaatgatcacaaataatttaaatgtttattatttattcaggcaaattcaaagggaaaggcattcccttggctctcactttatccactcaatatttttcagtttcttctctgtgaaaagaaaggtatttaggtatagtttagataggaaggcattgtttaggtattatttagggtggaaaaccaaaaccaattacccatgatctaatcgttgtttttaagatgcttattaggacacagaaaagtggtacacaaaagatatcagacaaggaaggagtgatgagttctaccaatgaggttaaaataaaatgcttttgacacttaaaagaaagagttttagattgagacttaagggaggtttttgaagtgggcctttgaagaatggataatatcatatttgatcctggacactggtgtgagagttatgttttcctttgaatgacaatatagatttatagtaaaaaacagaggagatatatcaatgagtgtttcattcatgtagaattagtgttaactaactcatattgatattctttaattattaattattggcaatgaaagtatacagaaaaaaattcataaagttgataaccaattcttgactaatgaaggaactaccaatatcatagaattaaaatttaaggaaaaaaatatattcctgatatagtcttccacattagagttatatgctaaactggcttctctttttttatatttctctaatttattgtttcagtcgttttattgccaattaattgaaatggttaaggatcacaggtttaggaaaacatttggaaaaacagattttagtcagcttgggtctatatcaggaaacttgtgaagatctttaatcacaatgagactttgaatcaagtatacattttattaatatttcttctcttgtttaacgtgataatacaaagatgatacaaatagactttattttgatttgtgatacccactaggttatagaaatattagagacttaagatttttgaaggaaagaaagttgtcacagcagctgttctcaacgaagtgagaacctcatgagccaccgcaccctgttaagatggtttaacacttgaatggattaaggagaataaagcagtaaaatggaccctcagatcctcaccaatattcctattaaaacaaatatacacaaatgtgtatttcatagtgaaatatactttttcattgacaagtattaaactattaaaccatttcagggactttttgcaattatcaaaattgttcagtatgattcccagacctcccacctccagaattttctcttaaatcagacttattgagatacaattttaacctgctctctttacttacatctaagagaaatttttttttttttttccctcgagacggagtctcactgtcacccagcctggagtgcagtggtgcgatctccgctcactacaagctccgcctcccgggttcccgccattctcctgcctcagcctcctgagtagctgggactacaggtgccgctaccacgcccggctcattttgtgtatttttagtagagacggggtttcacggtgttagccaggatagtctcgatctcctgacctcgtgatacacccgcctcggcctcccaaaatgctgggattacaggcatgagccaccgcacccggcccagaaattgttttaggtatgaccaaaatgaggggtgagtaccttctcttcagttaggtcttactttgatttttcaaacatgaggtagatgatttgggccatgaaaagacttacatcaaatgccaattcaattttcttttttgtttcctgggtaaaacaatgtttaaatataatttacatgtttcctgccctctgtgaacattttttttttttttttacaattttttttgtttgtttgtttgcttgtttgtttgtttttgagatggagtctcgctgtgttgcccaggctgaagtgcagtggtgagatctcggctcactgcaagctccgcctcctgggttcatgccattctcctgcctcagcctcccgagtagctgggactacaggcgcccgccaccacgcccagctaatttttgtatttttagtagagacggggtttcacttttttagccaggatggtctcgatctcctgacctcgtgatccacccacctcgacctcctaaagtgctgggattacaggcgtgagccaccgggcgcggccttttttttacaatgttgagttcacctgaacttctacttcagtgagaaaaaaaaataattaactcaaaaataagactttgtttcaagagaatagaaattgtcctgaccttttttgtaatctcttctggggccaacataataggcaatgaagccagccaatcataatgccattattgcatgtgaatcaggttcagggggcaggtccttttctgtgctttaaaagtcacattaagtagtattctagcatacttcttggacagaatatttcattacaggaactttgtaagtattgtgtgtttcatttgttggaacaagtgacatttatcttctggtaaagtgaacaaagatctttagcacaatagaaaatagtcacaatcgtcttgttctacttgtttctcacaagtaataaagaatgatagatgaatgctaggagagttttttgggttcataaaagggaacttgattaaggaactactgctacagaaatgaacttagaaatgacgtaatgaaaatgatgagggatcattctctctgctccccatggtagttcttcctgggtatggctgatcctctgctgccaagtctgctggggctagtctagggatacagtgatgaagagtctaccctctcctctgtctctctcatgtggtcttatccgtgcgtgaaaaggtgcagaaatcttcgttgctggtttgtactgtggcctatattcagaaaagtgtgcttattttattttttttatatttcctgtctccctatttctctaccccctctccccaccctgatataggtcctaaacctatttctggccttattattgagttcatttagttcagacaatcttacagcaattgaagaagaccctgatgcaaacaacctccagattgcagtgaccaggattaaaaagggaataaattatgtgaagcaaaccttacgtgaatttattctaaaaacattttccaagaaaccaaagatttccagggagataagacaaacagaagatctgaatactaagaaggaaaactatatttctaactatacacttgctgaaatgagcaaaggtcacaatttcctcaaggaaaaagataaaatcagtggttttggaagctgcgtggacaaatacttgatggaagacagtgatggtcaatcgtttattcacaatcccagcctcacagtgactgtgccaattgcccctggggaatccgatttggaaaatatgaatactgaggaacttagcagtgattcagatagtgaatacagcaaagtggtaagaatgcttcatatactttgtgtttcatgttaacaattagtatgaaatgaatgaaaatttcagatttctgttgccataagttcttcttaacgttgcatatagtgatggatagttttctgtgcatgactacacaacagcttcctgaagatttatctggtaaagtttagttactagttcttaataattgatttaatcttacttagctgtatgagaaagcaccaggtatctttgagccttcccattcttcatcccctgttgcctgtcagttgcaaagttacacacagtctccctccacagtgcctgtttgaatccacctctccttttcatcacctttcctttgtcctcactattttttgcctaaaccatttcaagcagagtctcgactgatgcctctgcttccattttgcatttactctagtttacttatttgattaatttcactcacgcagattcagtcctaattatttcactgccatgatgtatccatgatctgcaaaatctctctctctcttttttcttttattctccttttttaaaaaaaaagaaaaatggagacaagtctcactctgttgcccaggttggagtgcagtggtgctatcatagcttactgcaaccttgaactcctgggctcaatgatccccctacctccacctcctgagtagatgggactatacgcccatgccacaacacccagctaattttttaaaaaaaaaagtttgtagagacaaggtttcactatgtttcccaggctggtctcaaactactggattaaggcaattcttcaatctttgtccccagttgctgagattacaggaatgagccaccacacctggctatccccaaagtctcttgaattatgtattgtgcacaaagccttcacactatggccctaaccagctttgaccagctgtatctcctagtgctcacctgaagatttgtacctgtaccaaaccaatttccttttaggccataaacactgtccacactttgcttgggatttccttctccagtcaaaatccttcaaggcatcacccttgtatttatcatttattaaattgttaatacttaaatcacagttgggtaaaggttaaatgaattaacacattaatacatgtaaaacatttagaaccatactcaacattctcaaaatgttactcatttcatccctcctaatttcttcccaagtggatctagtcccttctcattttgaaccccaaacaattttatacctcttcctggattcagtaatcttaaattttaattttttgagaaattatggtatgcctctaatggtactgtaaattcattgagaacagaaactcttttaaaccttcttttgtgccctcctctcccacgcttacctgcatatttctagtgaatcaaggtatatatcgagctctattttttttgtgaaatataacaaccgtattacaaattatgtttatggtgttgttttaaagtcttaaggtatcatttaaaaataatcttttgttttctgtagctcatgttaggaagtatttgacagatagttaccaaatatcttctatctccttaacttactaagactccaccctccatgaatttatagtggcctttgaaaaaagattatatggaataatcattatatatatatatacacacacacacactatatatacacacacatatatatatgtgtgtgtgtgtgtgtgtaaaatgctcaggaggctgaggcatgagaatcacttgagccccggaggtggagcttgcagtgagccaagatcttgccactgtactccagcttggactatagagtgagattctgtctcaaaaaaaaaaaaaaaaaaaatacatatatatatatatatatatatatatgagattaaattaaattaaaacaaaataaaataaaatactctatatttagttgagtgaataaactattaaatcaataaatcatgatatatgtttctatgtagccaaggacattttttccaagatggtaaagtaaggaataaaatatagtcatcccttgatatctaggggggagtggttccaaggctccccacagagactaaaatctgcagatgttcaagtcctttatataaagtggcacaatgtttactatataacctacacacatcctctcatatgtacactttaaattatcttcagattacttataatgtaaaactaaataactaacacagtgtaaatatttgtcttactgtattttttatttgtactctattttttattttgtacaataaagttgtatttttatatttattttttccaattactttccatctgtagttcgttgactctacagatgtgggacccagggatacagagggccagctttattttatttgtatattttaaagtcttttacatggaagaagtaatactcccaaaattttaaaagtgtgttcatttcagcttaaagttagaaaaccagcttccacgtatgccttttaaggagcaggcaactagatttagtatcatatggaaagggaaactaactcagtcacccatttttttctaactaactcagtcacccatttaaagaagattaaaattataaactccaatcgcctggcagacagttgctctcagagtaaaacttggattctaggtgttaaagtccttcaggagctgggcaaagtcaaccaaatacttctgaaattatttcttaacatttacgaggaattatttcttacctgttcatttttctttcttttaaagccaatggctgacctttcatggatctccttagctgctgacaaaattcttattcttagtatgttgagttgtaacatttttaagggaaccttatagaactttccatttagcacttcattttctaactgaaaaagcaggctcattaaaaggaagtgattttattcacagttataaagctagagttgtacagttataaatccagagttatatagttgtacagttataaaggtagagccatgtcaagagtcccagtcttgtgacttacagctcaatggaatttctacctctcttgccctctctttctccatttgaaagacaaaacaaacattcctattgaacttaatgttcaatttgtctcccctggggtataaagccatgcagctatagaattcatatatctgtggtatgcagatgaaggtgtgttgtcataatggtcagctatcttttataattagtgattttatttgtcttttgtaactgaaatcgattattttaaccatctgtaaaattactctgccacttattccatgagcccttcctaaagagtatgaaatctagtgtcctataaactgagttctctaaaaaccatttgatgttaatattttaatattcttgattttcactattttttctcattacataatggtcatatctatgtgataaaagagtgtacattcttattctattacatttctatggtatacacaatcaaatatacaggggtttgaggctaccttagaggttgtagtaacgggtacacaagccagtatttttaagtcatttagcatagtatttgaattagcaagctattaaaaaaatttttgttatcatcgatttctgcatcaatattattacctaagaactcaggttcttagtgctactgacttctaattatgaactttgaaagtttacccttcttcataaaaaattttccatgacatatctcaaggtatgtcatcttaagtatagacaaatctacctgaagatgtaagaattgagaaataatgaaggttcaagatctaaaggaaatttgttagataagatattaagctgtgggcaactataaaaaccttatgtctaaggtctttctttccagcctcttcagatgaaaatgtttccagtttaaattttgtcatttttgttttgttttgttttcccatttggatcaccaaaatagtgcacattttctttatttgtctaaaatgtttctaatcctcctatgctaacttttcctgctctaattctcataatcttcatctcccacttgagttcctagagtcttgaactgtgaatcccctcctttgcaacttttgtttttttcatatctgagatgcctttgaaatagtgatggttgtgtttatgatgagcctggatgagccaaaaaggcaaattcgattacccaatagaaagtaattcctaatttatatatttatgtcattaagtcttagccactaccttgggatatgattaagaacgccacttttaatttacaagaagaaaacaaacaaccccatcaaaaagtgggcaaagaatatgaacagacacttctccaaagaagacattcatatagccaacagacacatgaaaaaatgctcattatcactcgccatcagagaaatgcaaatcaaaaccacaatgagataccatctcacaccagttagaatggcaatcattaaaaagtcaagaaacaacaggtgctggagaggatgtggagaaataggaacacttttacactgttggtgggactgtaaactagttcaaccattgtggaaaacagtgtggcgattcctcaaggatctagaactagaaataccatttgacccagccatcccattactgggtatatacccaaaggatcataaatcatgctgctataaagacacatgcacacgtatgtttattgcagcactattcacaatagcaaagacttggaaccaacccaaatgtctatcagtgacagactggattaagaaaatgtggcacatatacaccatggaatactatgcagtcataaaaaaggatgaggtcgtgtcctttatagggacatggatgcagctggaaaccatcattctcagcaaactattgcaagaacagaaaaccaaacaccacatattctcactcataggtgggaattgaacaatgagatcacttggacacagaaaagggaatatcacacactggggcctcctgtggggagggggaaggggggagggatagcattaggagatatccctaatgtacatgacgagttaatgggtgcagcacaccaacatggcacatgtatacatgtgtaacaaacctgcacattgtgcacatgtaccctagaacttaaagtataataataaaaaaaagaatgtcactttttaagatagaatatttgcctcaaatcttagcttttgatatgacctcgagcaatttacaaaaacctttttttcagtttacttatgtgtaaaatagattgtaataaaaattacatgattctcataaacaattagaaaatgcttactgaaaagtaagtgctcaatgtacaattattataagtatggaattgagtgcttacatacacagtgtaagtagctgttggctacagattgaatttaaaagagatagcatgatgaaaatcagtgcttcagaattttagtgtgtgaaagacatacttggggactttattacaaatgcctgttctggatcatatcctttgaattgtctttgcctaaatttggatgcaacttcagaatcattaacaatgtttgcagcagctactgatcattagagactactatgaacaagcatacaccaacaaattggaaaacctaatggaaattgataaattactcaatacatacaacttgccaagattgtatcatgaagaagtggaaaactcgaacagaccaataatgagtaacaagattgaatcagtaattaaaactcctagcaaagaaaagtccaggactacatggcttcgctgatgagttctaccaaacatttaaaaaagaactaatattaattcttctcaaattattccaaaaaaatcaaaaggaaaggaagtcttctaaactcattctacaaggccagtattaccccaataccagaaccaggtaaggatacacacaaaaaaagaaagctagaggccactatccctgatgaacacagatgcaaaatgccccagcaaaatactagcaactcaaatccaacagcctatcaaaaagattattcaccatgctcaaccggaaatcgtcccagggatgcaaagatgtttcaacatttgcagaacaataaacttgctacattatatcaacagaatgaaatgtaaaaaccatgtggtcatctcaatagacagagaaaaagcattttataaaatttagtatcctatgtttgataaaaattatcaacaaattaggtatggaagaaacataccttaatgtaatgaaggccatatgtaacaaacccacagctaacatgatactaaccagggaagagctgaaagctttctttccacgatctgaaagaagacaaggatactcactttcactacttttattcaacatagtaacgaagttcgagccagagcaatcaggcaagagaaagaaataaaggacatttaaattggaaagaaggaagtcaaattctctctgtttttatataatccgatcttagatatagagaattctaatgaccgcgtgaaaaaaaatatttcataaatgaattcagtaatgtttgaggacacaaaatcaacatgcaaaaatcagtattatttctatatgttaacaaccaataatctgaaaataaatcaaggatgcaatcccatttacaatagctacaaaaaataaaatacctagaaataaatttaaacaaggagatgaaatatatttacaatgaaaactataaaatattggtgagagaaattgaagaggacacaaaaaggaaaagatattccatgttcatggattagaataattaatattgttaaaatgtccacattacccaaagcaatctatagatttagtgcaatccctatcaaaataccaatgacattctttacagaaataagacaaaaacagtcctaacatttgtgtgaaaccacaaaagaccctaaatagcccaagtaacctgaaacaaaaagaacaaagctggtggcatcaccctaactgacttcaaaacacactataaagctatagtaaccaaacagaatgatactgacataaaacagacatatagagcaatacataagaatagagagtccagaaataaatctacacatatacagttaactgagttttgacaaagtttccaagtacatataatagggaaaggacagtctctttagtaaatggttctgggaaaactgaatagccacatgcaaaagaatgaaattagacctttatctctaaatttttatacaagtcaactcaaaatagactaactaaaatgtaagacccacaattacatgactatcaagaaaaaaaaaatggggaaagtttcatgatgttggtcttggcaaggatttttttttatataaaacctcaaaagcacaggcaataaaagtaaatatagacaaattggattatattaaaaagcttctgcacagcaaggcaaataatcaatagagtgaagagacaacctacagaatgggaaaatatatttgtaaactatgcatctgataatgggttaatatctaaaacatataaggaactcaaacaactcaacaacaacaacaaaaaacaaataattcaaaaatggacaaaagacctgaatagatatttctcaaaagaagacatagaaatgccaacagatatatgaaaatatgctcaacatcactaatcatcagggaaatgcaaatcaaacctatattgaggtatctcctcactctagttagaatggctaccatcaaaaaatcaaaagatgaaagtattaaaaggatatggagaaaagggaatccttacacactgattatgagaatgtaaattagtaccaccattatggaaagtaatatgggggttcttaaaaaaattaaaaatagaattttcatatgatccagcagtcccaatactaggtaaatatccagatgaaatgaaatcaatgtgttgaagagatagagtaaacatagaatactatactcttatatgtttattgctgtactgttcacaataaccaagttatcatattaacctaaatgatcataaagagataaatgcataaagaaaatgtagtatataagaaacattgaacatcattcagccataagaaataatgaaatcctgttatttgtggcaacgtgagtgaacctggaggatattatgttaagtgaaatcagccagacacagaaagtcaaatatctcacacatatgtggaatctaaagagttgtcatagaagtagatagtatagaatagtggttatctgaggatgcgaggcttggaggagcgaggtatggagacagatttggtcaataggtacaaagctgcagtgagatagaataagttctggtgttctatggaatagttggatgactagagttaaccataatgtattgtatatttcaaaatagctagaagtttgtaaatgatctcctcacaaagaaacgataaatgttcaaagctatggatctgctggttaccctacttgatagttacatagtgtatacatgtatcaaactatcacacgtaccccataaatatgtacaattattatgtgtcaaaaataatttttaaaataaatgatggtaatctaatccctagcttacttgggttcaggtttctgagatactactttctttattcaggggctatggatatatttccccttttggttgtttaagaacctgcattttgagtaaggggaaataacatcactaacctttgatatctctccctctcctctccctacccaaaaaccctctcttttatgacttagcatcctggtttctcaatatagtttatgcagaattttcaatgctatcctagtataagttttcaggttggcagatttcctcatcctgatagatagttaaaaatacactccagaatcaaatcaaaatattttacagtaaaacatcttatcagaaaataaccaaagcgatgagttcaaacaaatggtttagtcaaatatcttaaacagttctgagtaaacaaatggaaatagaacaatagcacttctctgaagatacagtgtcagaatcaagaaaggcatgctgttatctcaaaggtacccatgagaataatactcttttcactgtttctaagaatgcaggcactgaactgacgtctcttctcagagtcagtcttttcttgaagtgcaatgaagccctccaagcacgctccaaacattaacaacacactacacaggtttttttttttttttttttttttaccattggcagtgaagtgcttccttgttataaaccttaaaggaagcatgaaatgcatccattcatcaataaatatctattgcaccttactatgctgtaagcactctgctaagaactgctgagggaaaaaaagttcatgttctcacacaactgcaataatttaatatctggattaacttgaaagttaaaatataagagcccagcgtctagatatataagactgtgagctgatccaaggatgtattagtttcttagtgatgtaacaaattagcacaaactcggtggcttacaacaacagaactttattcttttgacagttctggaggctagaagtctgaaattaaggtctgagcaaggccatgatttctctaaaggctgtagtgactatacttccttgctgctttctaactttggaggttgttggcaatccttgcagcttgcagctgcatcatcccaacttctggcccggaacccacatagttttctccctgtgtgtctctgtcttttcttcttataaggaccccagttacattggatttggacccacactaatgccctcatcttaattgtatctgcaaagaccatatttccaagtaagatcacattcaaacatgccagggttaggacttcaacataacttttggaggattacaattcaacccataacaaagaattttgacttagaagactggatggtttttttttttttttttttttttttgagacggagtctggctcagtcgcccaggctggagtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagccaggatggtctcaatctcctgacctcgtgatccacccgcctcagcctcccaaagaggtgggattacagggactggatgtttattgatgcaattagggatatactgatggaggagaaaattgaggaggtaggggaaatacagagtttaatttggtggcatcataaatttgagctacttgcagtacaggcagtgaacctgaacaggaggtatatggaaacataaatcttaaggaaagaagaaaagtcagagttgtagataggttggaattttgtatgttaacttttatttatcacaggattgtgtagggagtcagttccctgggaagccaatcctgagagagaaatctgtttgtctaagatttactgagagctgttttcaggaacgatacctaacatctgtaaaaagtgagggatgcaaaattattgggcagagagagaagttgaactgttacaattgcaacagagatttcggctgatcctattggcatccctggtgccgggacgaccctttggagtagtcccaaaacaaagcaagagggtcaggcctttcttctccataccatgccttggatgcaggctttccatttacccttccaggggagaggggcataaccttgggggaagcacctcccttctaccacgataatgcccaaagggggattcggatgtgagccttcagcagccaacacttttggcagctgggtgaatgagcagctcactggaaagcaggatgtgcacagtgccttacagcatgtaccgcacgacagagccatagacagaagctgagaacagtggatcaaacacatttgagaggtgggtgcaaaagaagaaagcacacacacacactacacacacggataaaatgtatacagtagcccctttacacacattatataattttcccttttgtgacctccttaggaagtaaatgtaattcatctatatttgcagatgactgagattctaaaagattaagaaaagattcgtttagtcacagatgtgtctgggggtatttttaaatttaagccccaagctttaatcgttatattacatgccatagaaaggcaggagagtgagtaggaatacaattgttttctgctatacctctgcaatggtgtaattcaggacgaaatttctgttgtaatggtattgtacatttgctgattcattgggattctgatattgtgcttctaatccaccttaatgctgactgattaggttatagtttaccttggtaataatgtgtgatttttatattttaagtgtttaaatttgtttcttcaaaactatcttactcacttctttattggaaagtaaaactgattttacttctagaatatatttctttctcaagactacattaccctttcctttccatttattcaatattaaacgcatatttcatatattatagtatttcatgtgtatctgtatatttatttgcatatatattaatgtatctctattttttcatgcaaattattgataaatatgacaaactcgtcttgaccaaactcaagttcttgtggcttctgcctgatatattcattcttttctggtgaaagccttgctgaggtaactattaggttcttaatgctactaagacttatccagctctccctggcttgttgatgaaattggcaagtgactcagaaatatcactaaagtccagatcactgcctttaaagcatctcctttgtcatgacatattatgttattacagaaaagtattaaatcaatttggcataattttttctacacatcgctttgctctctttgaaactttgtgttctctcaggacaatgtattaagtagaattgatttattattatattatcttccacattaaaactatattaagggctagggaatacacttactgccacaccaaggtacacatgttaagatcttaattatttgaataaatctattttacttaagggtacatggataatccctatttttttttgtattatgttatttttggctatttcggagtcaggactctgtttaactgcatgcaacagagacttaactatatcagcataagtggatagagcattctattttcatattttaaaacttccacagatcagcagtccacgtggcctccatgtcctaggctccatctcttctcccttctgccagtcttcatatgtgttttttcttctatcttaatgcctataattagaggtgactgttccacctacagctttatatccaatactcaggtaggaaagagaaagaaatagacagaagcagaagtaatgactatctcacttgcctgaggaaaagcaaaactttcccagagatctttatccaactttggcttatgtcttattggcaagaacagtgtgacatgaccacccctaacaacaaggaagcctggctgaggcaggacatttatccaggcatattgctgccctgaataaaatctggattatcttagtaagatacattggaagacattaacaaggtcagacatgcttctccaatattattactgctactaattattattattcctttatgaaaatgtcaaaagaattgaaagatggtaattttctattttaagagatttagttactaggcatagtttggaataatgtgcatcaactataatgttatactttgaaacatattgtataaaattaccaagaaacaaaatttaatttttatttactgaattagtatatatgaaaataagaatatattaagttaaataataaaaaactaaatatctaaccatttttaatatgcaaaaagtagaaatttcacgtggctcaacatagtataaagacataagtaaaatataaactttattctacctgtataatcttatttcttaattacataaatgtgttactgaacacagatattttatttattttttgtatttgtgcatagtagagaacacattaaaattttctatgactatctgcccagaattgtaataggcatagagtttttctctcctaaattacactcatgaaatatttttgaccccctataaatattgagtcccccaaaaaccacactaaaaacttcatgtacttcaaaggtaaagggtgattgatcattgacaacaaaagtttacagtctaatagttgcaccttagataaatacacaaaaaattataacacagaacaaagcaaagcacaatccataacaggacactaaactagtccattgaggatgcattgagtaaggggctatatcaggctgacttcacatgaaaggaggtggcacttaagccagaccttacagtatggagagaatttcactgggcagatgtggtacagaaggaaatctcaggcagaggaacgagcattcatgttgttcacctgattcactcattcattcgtctgtccacccattcatctattcagtgttcagtttacaaagtcattatctttagagagacttaaatatgcttattattatgaaatgtagtcattttattgacttgataaaaagttgtttcaatatttgcagttctcaaagttaaatatttaatgtccttttactatgtggtggttttaattatattgttatcaagactttctctcgttagattttttaatcaaagttttttccttaatttagatttatgttctgcttattactacactttagaaaatgtaataatcttttaaaaatgcatttgactttgaaaaatttagggattagttacagttatgctgttgggtaaaactggcatttgattgtattttttatgcatggattttttaaaaagcactcttctgtagaattgcacttagaccatttctttttttcaggttgtttccaaagaatttgaaaaatctttccatcttcatttgttgatgtgcctaaaaacaatgaaatatttgtctgacatattcaaatcaatgtgtcttgttctttatattttgataaatttggaaacttcacttttttgcaatgctgtttaaaatgtcaaaattaattaattaaaaataaaagtcaatcaagacatgttaattttagaatatgctttttaaagctgcatactcttactcccacttcaccccctatactgataatcacttatatttaaatgttgcttgcatttaaggaaaaatagaatgcaaaacattgcattagcacattatagtaaattcaattcctaaataatagaattatgtaactgtttaattgattgttttaaagtctctgctgaatgacatttaatcttagtattgtgattctaatatattgcttaacattgagtatatagcatgcactttcaaatatgtaactaatttctacttataggtatatgactttaaacattttaaaacacagttgactaaactttcatcatgctgcatttctaaaatttggtacctaaccttcttacttctcacaggggtaaaatcaaactggatcaatcaaggatgcagctctgtgcttttaaccaggcagagacatatgtcaccacttttacacaggttacctaaaaaaatcatacatacgatattttttcaatgtcttgcatgctgttcagctacaaaatctttctgcctgacccattgcaagagagtagaaacatatacagttgctcaatagataaagcgacatcacagcatgtcaccaggacaattctattatattttttgtgattctcttgatgacttctttgatgtaaccttcatgtgcttaagtgatttcaagtgcatgatctgtagatttttattgaattgattataaaagtaaaatgcagaatgtaacagtagccattgaagcaacatttgatttgaaaacctctatcaacttcccttcctgattaaatctacataaaaatatagagatgtttatcacattaaattgtcacatttaaattaagtagatcaaaactctaaaaaattgtggaagaaatgtttctggcataaatataaaatctcagagcaggaaaggatcattgtagttctagctgtatatttatggataagtaaattgagactcatgctttcttagtacacatctagaaagctggggtcagagccaaagcaccctgcttctagtataaactttgaatacattttgaaatggttttaagcactgttagttatgggactttatttttttaaaatcaactcagtaattaatttgattttatttcctcctatataaaatgcatcagttaaaagtcgataggccttgcctatgaatgaataagtgatacgtgttcaaaatgtttaattttattccagaagtaatattactcattgatgagaataagtttctgattacatacctaatcagagtggcctctagaaactaagaggtttagatagagcacattatgaagtgaacactaaacctatctatcaataacacatagaagacttttactgaaattagatacagattaatatgtattgccttattgaatatttctaaaaggtattaaaaatacatactaagatatattttaattttagcataacttgttgaatgaactttaatagtactaggatgggggaaggaatctctgtcaataagaattttgactattttttataatctagttcatattttgaatttctctgtcattgttgagatgtttgtattattgttatcttttgtgcaatgatgaaagcaaaactttatcctgaaattgacataccctagggtgtgtcattgcagtttcaaatgaaaaattagttatttttgtgttccagtttattcaaagataatcttaaaggtggcctaagtgaaagatttatttttctatttcaaatttggtggggatttagaggcaatatactcatagaaaactattttattccagaatatggtgaattttcttcaactagagcctaaataaggatgcatatacgtccaatattatctatataggtatagataaaacatacaatttttgagaaagctatttctagaactatatatacatgcatagacatataaacatatgcatatatatgttttgaattcataaattattattacttttttaccaagctattagaaaagatgaggcacatgttataaatagtcatcctcttaatcaagaaaaaactgaatattcagttaagaatgacttgaaatatggcactttagcaaaagttgcttacataagggatagagttattttattcatgtaaaatttctatttacattatattttcaatattagaaatccacatgtttaaaaaactagtaattattcagctcattaaaattcacttttccttgccctccttcattgtgggtagtattagtggttaacagaaatgattcagattcctaggtagcttactttgtgtttgtcattcttgcttgttttaaaattatatataatatttacaaagcttgagtctgagtatctacactttgcctttgtgtttgctgaggttccaatccttctttacctacatgttgcattttttaaagctggcatgaatagtaaaattgtctaaatgtttgcttctaaagattttaagatactctgacttgacccactgtgttccagctgctttctctgcaaacagtatagcagttctgtcatgcgcctctgtgtgaagagaccaccaaacaggctttgtgtgagcaacatggctgtttatttcacctgggtgcaggcgggctgagtccgaaaagagagtcagtgaagggagattagggtggggctgttttataggatttgggtaggtaaaggaatattatagtcaaagggaggttgttctctggcgggcaggagttgggggtcacaaggtgctcagtggtggagctttttgaaccaggatgagccaggaaaaggaatttcacaagataatgtcatcacttaagacaaggactggccatttgcacttcttttgtggtggaatgtcgtcagttaaggcggggcagggcattttcacttcttttgtgattcttcagttacttcaggccatctgggcctatacgtgcaagtcacaggggatgcaatggcttggcttgggctcagaggcctgacaagttctgtgacagagcacagagacaacccttgaatatcaatggccactttacactcctagctcttactagtaaatgcttctgttcttttcattagaaaaatacttcaagatgatactataggacctggctgagaaatctgtagccagtccagccttcttatatggccaagtgttgttgcttttgtatgatttttaaaatattcatatcttatcatttagtcatgtaagtgttcatgttactggatagaaagtgccctaggtagaagattctgagaaaaataagagctctccatgaaatcattggttttattttgaatttctctggtggtggctgagatttgacctcattatttcaccaacagaatactatatagcatgttgaccttgtgatggaactgtgtgtttcatgctgaatgagtagctgttcctcccagagcctacacgatatttctctgctagcaatagacaaagaaaaataggaaaggaaaaaaatcggttttattgcctttttttaaaaaaaagagctaacgttttagttgtccataattagaatgtgagcccagaatttattgcaactagttaataaactgacaattttctgctaaattagtgaaagtaacattaaaacttagacaacagaagaaaatacagttgagttttccactgatcaataatatctggagtatttttaaattatttccattttttcctgaaattcctgagcttcagttattttttaacttgaggcattacctttcaaaaagaatcttgagaaatttcatatcaaaaacaatattgcagagaccttgaggggcccagaaatctaaatcatgttaagaaatgtcattacactcgccgggcgcggtggctcacgcctgtaatcccagcactttgggaggccgaggcgggcggatcacaaggtcaggagatcgagaccacggtgaaaccccgtctctactaaaaatacaaaaaattagccgggcgcggttgtgggcgcctgtagtcccagctactcgggaggctgaggcaggagaatggcgtgaacccgggaggcggagcttgcagtgagccgagatcgtgccactgcactccagcctgggcgacagagcgagactccgtctcaaaaaaaaaaaaaaaaaaaaaaaaaaaagaaatgtcattacactcaagatgaaaagcacaaatagtaatatcaataatattaatgacctccaattttaaaaactctataaaaggataatgttcacacttctccagaaggaacaaaataaaggccctgaacaattgcaagagagaaggaaggttatcttggttctgcaccagaagagggtatttaaacaactagttatcctgtaacataatgggaaattggaaattggactcttatgccacatagtaactatgtgtggaattcttctcaaagggtcctttgatcctttaatcgaactttactattttactccttaatgattcaagaacacaattatagatattgatggtaaaactatgcagttaaattaaaagatggataacagtaacttgaaactaattttaaaatgtctttcttgcttactaacagataatggcgcttagtttaccatgaatgtctgccataatttttcttctcttttatacccatctcctccttttgattttcttctctcaactttcttactgtcttttgtgagtattttaaggctcaggtgaaataaccattctaggctctgctccttaaagaatatctttttttgttgtgtgaagcagagtttatagtatgtactttaaatgtaacacttttaggttcttttcagcatcaatcattctctttgagtaagatttttgttgagttctgtgttttgtacagtgccgctatatgtttgatagtttcttcttttgagcgttagattatcaagtcattagatattcctacttcacacctcttggaacaataattaactaaatagcgttaaccaccatccatgatagcatgaaataggcttgcattgttaatgtttatcttaggaaatgccagtgataaatttgtaagtgaacaacttaggacatgttctaatgtgatacatatatttaacgtaatttctactcaagcagtatagtagaaaacacagcttcaaggcaatcaaagggaaaaccatgaagaataataacgcttttaatttgaacatattttcagtaattgaaaggagcatcttaaatagctacataagtttacaatcaagataaggattatttcacagctatagtgttgtatggatgcacactgaaaaatatggaaagatatgccaatttctctctctctctctcctctctctctctcccctctctctctttctctctctcttgattacctcaggggggttgaatcaaggagatagtggaggaaactttacttttgcactgtaaatattatacatttaaaatgtttgagtcaactatatcactttcatatttttaaaaagacacttttagaaggcacttacagtcaatatcatattattcaatgaaaaggcaagaatgctaattatggtacacttctgattcctaataccaatgagtccaccttcttgatcctatgcttacatttatatttattttatttataagtagactgccaatgataaaaaattgatatttcccttttattagaaatcaaatccatgtgaaaattacagaaggtcctatttataatagcaaaagaaaattttttcatactaaagcatttatttcacttctctaatatagtatagtcattctttcatttccaaaattacttggaaaactaaacaacagatgattgagtttaaagaaatgaaagtaatatagaaaataatcatataaaataatacaaataattgatatgatcttccttatatagtacttaaatatggtgatgcttactgtgagaattcaataaatttcaccacaggaaaaaaactttattatatatatcagcctttctatataaaggtattctcttagaactctgctaaagaagcttatactatagcaagtgtagaattcaaaggtcaaattgattaaaactgtctatattgctaaagtgtgcatataaatatttaattttatatacagtattgaaatagttactgtttgaatacttaatgcattcccaagaaaaccctgaatgtgtaagaatctattagccataataatttgactacaaatacgaattaataatagttcatatcaaatattttgataatttctgacccattaaataataatatttaataactttaatttatgacataaaattatgtgccaagctgaattcaattgaccataaaaaaatataaaacctgcatgtgaaaaaaaaagtttcaatggcaagatacactacgtaaaatcactgaaatttttacttgctcataaactaatttggcataaatctttgttaatgctctcttaaacagtgagagaaccaattactgatgttgaagatgctttcatgaatttagcctaagtcagaattctgcaaataagaatcattttatttaaaagttgttaccagctcagagaaaacaattataactatttcctattgttaatactgtgtctaatagcagggaggtgctttgtattctttctatcagcaattcctcccactgccttacctcaaaacccaggccaataattcttttttcagaattgaaggacttggtcttaacttcacagaataatagggccctgtctttcagttccctgatgatagttcacgtgtagccgagaggtcaagacttgaagccgttcaaactgtagtcttctaaatatggtactttggattttgtggcaattggcacaaaatacatattagtaattataagtttatccaacatcatttcctggattaatctatattttaaaacttgtcatatatactttaaaactcattctatagtttctattttaaaacttgttctatagttttatagaatattcagttataattaatttctattttctaattttagattaaactaatttagatgaattcaatccgtttaaagaacctgtttttgagtgaaattgtgtactaacactttcataactgatactgtcatcaaactcatggacctggtgggaataatgcctctaggccaacgtagactagaggagttcacttaacagtttgttcataatttttactccagttataagaaagacttggtctgcttacatcattccttatgtacaatactttatcaatgccatttttatgatgttgtatactaggtgataataatagcattgagaatttaatgtggtacccatcaagaatacttccagcttccaagtcaatctctaaaaatcaaacctttggattgggcctatgatattaatacagattcatagatcaagaatcaatttatctgaaataagtactttattatttttagcacttgcacttgcttgaactactctaaaaaagataaagttgtaacttaataagagaatcgtgttgtagtaactagcagcttccaatattcatgtgtcatttagcaaatgagaatgaaaaattaattcttccattgatatgctgctttactcctttataaaacaatatttgggaaatttgacagagttttgctacaattgctgtatgtattttttgtaaagatttattcgtgtgtgtgtatgtgtaaacatcatggttactcataaagctctgggtgggaaaaacctatttgtgttatgatcagttatatgatcataatgacaatgaattcattactccatgtgtaagtctgccatgtttaattttcttcagtctttgtttcagagtttgcatgtggtgcttactttagtagccactttcttgacattataaataatactgttgtttaatcttttctacgatgtactaaaatgttatatacaaaataggtagtgttggtatggtcattggcattttgatttcaaaaccgtatttgattttgtggtcttgatcaaagaacttctatctatatcgtcctactacatgtatttaaatccaagagataataaaaaatacatttggactttatcttgaactcatctttttaaaaaattttaactattaagttttttgccaactatttgatctgagctttcaattatcaggcattagtaatttcacacttgtatattgcaaatagggtataggttgtcctcaaataatgattgtcagtgtccataaatttatattaaaaattaaaaaaaagtaagatgtggccaatactttccaaaagtgatagttaacatcaatatattaccttatctaattttggccacataactgttactgtaataaaataataaagtttattattttacaggatggtgtagatagaaagatcaagtatagatacatttaaggttacttgacctcaatatgtgtttatacatttttatggccatcatactattaatctttttttcataatactttgcatgagtctgattattaaataaggcttaaataccagatttgaatgaactctaaatgaactacctggtggggtggtgaattcctttctagagattaaaccaatcaagctcctcagagtgcagcacagttgataaccctttgcctggagaaggagaagaagcagaggctgaacctatgaattccgatgagccagaagcctgtttcacagatggtaagacaaaaattgagaccttggttagcattcctttattagtgttttggagtttgttttaatgcgtaatacttaccagagtttgttggtaagtcagaagactccattccatgctgattcagctatagctgtatgatgattaagggcaagtcactagagttctctaaatttcagtttccacatctatggcacttgactaacaataatttcctatcactgtatgttagactgtaagcacgctactgcttcttattttagagccttaattaatatttccagatcagtggaaccactagaatacaagttaatgaaagagtttatacttttgtccttttaataaaaaatggaatctactcactaactctcagaaaactgtttgatactgttgaccacagtctctctcaaaattcttcctgtccttagtttcagaggccatagtctacctttggtcttttatttgtcttagaattctgagttcctctctctatttctttaatgagtgttgtttttctgcacatcctgtaaataatgatttctccccacatgttcaaacttcagttatcttttcttattctgaagctccaaggtgtttcatgcatgcctgtggcttgaaaagccatttctgtgctattgactcttaacatcagtgtctttgcccctgacctcactcttgagtcccagatctgcttacagttccccattggtcatcaccatctgttgtttttaaaacattccaagtttaataagttttttttgaaaagggcaaaaacaaaaacaaaactttagcatgttttacagcttcctccagtctttaattagtaacttcatgatctatcttatcctcaagctaaagactttgagagagccttaaagttttccttgctagtcacaagttcatcaggaactctggagatagggcccaagccctcgagaggattttcatgcacactaaaatgtgtgaatcctttgccttcggggtaaagtctgaagtccttaactttacatgtaaagttctttacatttggccttagtcttttattttttaacggtacttctttctactcctgtatgctttctgatgtactgaatttcttactacttctggaatttgccagggataatacagtattgtctgaacaagtattgtatcatctaggtaaaaatacaagcccagcatagggctgtaatgtaatacaataacacaaagttcaaactttggagcctgataaacatacattctaatttgcctacttattatctgcctgtgagaactagtacacaatttaaaatcttgttcttcagatatctcatctgtaaaatggggatatcagcatccacatcacagcgatgctaagaggatcaaataagataatgattataaacttactagcacagtgtctatcttccttcttctacttttcttgttcttcaaggattctgttaacaatcttataaagaagctatgatagcacagatgctaatgacttatttagtcatgggcttaccctctgcattagtattttttgaaaaatcatcgacttgctttcagtctccaagattttctcaactagtctcttataacactcacacgtgaagcaaaatgattggaaaataaagacatcagcaaactacaacgagtgcatggtttttctttaaatgcacaccaaatatcattttatgtaaggagcaaaggtgtatgacatccagtcaatatacattttgcgcttgctgaaattagtgctataaggaaatgcagagtttcctttaaaagtgttcatgttatagggatttaagaatttcatcaacacgtatggcctgttcctcaagaaatttattagcagcatatagacttaaatttgtactgatgctaccaagattttccctattcattttatgaatgatcatcacttaaaattctaggataactagaaagaagttgggtttatcaatcaaattaaagtttcaaaccaaaaaacaacttcaaaaaacttaaagtcttacagaaagtattaacactgtgctatttcagactgtaggtactgttatactaagatataaagttttttaaatcctataaacatcaatgaaaatacttttgtgattactttgagaatgttcattgcttccaaattgaggccagtgtagaagaaatattatggaaacacattttccgatgaacctgggcttggaccattgaaatttactgagggagtactggtctctgagtcacatcccttttatgtgctccagtagagacttcatacagtctctggatctgtagcctaataaattcaatgaagcagccaatttgtttagcctttcaaccatgtattcacataatcattcttattcccgtaaacaaataattattaaatacctgtgtgccaggtccagttccaggcactggagggagacagagctgtgaacaaaacaatgccccttgctgaacaaacatatcaagatgtagcaggtcagacaggtgaaaagtgctatggagaaggtatatggaaaagaggaataccaagagtgagggggaagaacttactggcacataaatatgctatgaatgaatgattgatcagagaaagcctacctataaaggtgatgtttcttctgtgacataaagaaaattgaaggggggcatgcaaatatatggaagaaaagtattttaggcagagtaatgaagtcacatgccccgaggtgaggatatgcaaaacatttgggaaaaaccaaggggccaatatagatggagaataatgagaaatgagaagagtattaaaagttaaggtcagaggctaggtgaagtggctcacacctataattccagtactttgggaggccgaggtgggcgatcacttgaggccaggagttcaagaccagcctggccaacatagcgaaactccatttttactgaaaatgaaaaaaaaattagttgatcatggtggtacatgcctataatccctgctacttggaaggctgaggcacgagaatcacttaaatccaggaggcagaggttgcagtgagccaagattgtgccactgcactccagcctggatgacagaggaagactctgtctccaacaaacaaacaaacaaacaaaacaaatgatgttattttaaaaaagtatagatcaaagatgtagtagaggccagattataagacatttcaagaacattataaggatgtgattttaaaatctcacaatgtgcaatcttaagagtggaagggtgaatagcaatggcagaagctgggagatttcttggagtttctgcataaatccaggtgagaggtgatgggagcttagactagtatggtagagttttgtatagtgagggtgggacattctgagtatattttgaagttagagctgaagcaatttgttgatggattgaacatggggtgctcaaaaactagaaatgcatagtttccacatgaagactgagaagtatgggcttgtcagaatgaagaatcatgaacatgtttacttacaagttggtaattggtctacaagagctgaactagaatcaataccaattcagagcaatgtttcacctccagagatctctgttacctgaaaagtaatagaaaaaattaaagaaagtatgagaaacaattaaatccgagtagcatgtttttactgaagacaaatgttaaaatgattttgttgttcattgtctcacatttgttgattcatttcagcttcataactatcactttgctaatgtatttcattgattgcatctagttcctcttattcaccttttctcctccctcttaggccaggttgttccttagttccatgtcttttactttgtatttcaagacttcagactccttctatcttgccctgttctttactatccttggttctacatgacttggcaatctatataattatgaatatggcatgactctttgggtctatgtggttttatattgtgctgcttttagattatcaaattagtaaattacataatcaggattagagaaaaataacctttttcacaaggtcaagagatcaagaccatcctggccaacatggtgaaactccatctctactaaaaatacaaaaattagctgggcctggtggtgagcacctgtagtcccagctactcaagaggctgaggcaggagaatcgcttgaacccaggaggcggaggttgcagtgagctgagatcgtgccactgcactccagcctggcaaacaagtgagactccgtctcaaaaaataatgatgataataacaataatgtacttttctgttaacttggtaggaggagccaaatcaccttcctttcaaaatgttttgtattcacccacttcctataaaatgactaatcattaattctaactttagtaacacaataaccaactcctttgtgacttattttttctttctttggaaagataatgttaacaaatattgttttggttattttagacattaagaaatggtgaagaaagcttgttttcataatcaatgtttacattaattatattgatcatgctgttatagtttttaatgaatagtctgtctttgaaatggtcaatggtttcttttttcttttctttttctttttttttttttttgagagcattggtttaacatgatgaaactcagcatagactttatgtaatgcaccatgagagcacattagtgaaaccacccaaaagaaatagcatttactcactgggacccattaaaatgtatgagagattccctgttatgtttacatttaattaatagtccttttaaagagaaggtgtgatagcattgctaaccagcttggttggaaatctcttgggatatacctttgcacgaaaaccagacaggcactccatcactcttgcctcaaaataagagaaagaaactctctgaggtgtgataaaccctgagggcaatatttatgaaacttcatttcagattgaaagtttactaacttttctaattaggatttttagtgtttttatttcctcaatcataagaacaatgtttcccttcaactttaagatggacaaaagtaaatcccagagagtaaaatcttcttaaccaaagggataactttcttatccaataagttgtacctgagaaagatagattctttcttgtatgtgctcattgtttttaagtttaagacaaactctagagcactaagttaatattaaaaaattcatctcatgttttcactctcgtatttttatttgcccagaaaaagattaacttagagttaatttttgaccctacccttttactctgtttttatatcatttaattgaatgttctctcttaactaaatgcatttagataattatttaagtacaggatgataaataatttcagatctgagatcatgttcactgtaattagcattgtataaatgaagctatgtgtagattttccatcaccttttttttttctttttcatccaatctttatgtaaagtatagaattcacagagatgagacctttcaaattatggctaactgcttagaagattatataactctctttggggaatcaagtcttttaaaaatcgactataaatgacctattaagccaagtagaggacaacgatgagtaccgtaagcacagacagcaagcattagagactcagtttgagccttctgggaacttagaaacttccagagagaaagaacaggaacacataaaatatgcatgataacaaaaacaccagagacattgtagggggagagggaaacaccttgtttgctgtatttctatagagctggaaattaaagtgctagaaaataacctcatatcaactggatcaatgcactaattagacttcagaaacatgaaaaaatccattacaaaacattatctaccaggtgcatcttgtcaaaaggattctagttttgttgttttagaacatacatcttatgattatctgaagttgttccttgaaaggctcaatacttgttaatgaactatattgttttgcagaaaaggaaatcaattttttagaaatatctaaatttcaaacttctgaaacaggtatcgaaaaagtgctgcccattattactttcccacctcctgccttaatctaaaatgaggtttttcgtctaaaattttatgaggaggaattcattgtagttagtttttaaagagtcgctcttttcttcagagtaattctagttgctttaataaactttaaattgatttaaatttaatttttcaatttttcaatcattctctttctgggcctcctacgttcatagctctgtttatcactgcttgtaaaacgttttactctttagttcttcttgttcatctctcatttcatctacttcaaagttttctcctctacctgtcctagtgatgtataggtaaatatttttataaactggttctccaaagaaaataaaatatgcatacttatatcatttgttataaattttactgatattaaggatatatgacacacaatttacaaataataaaatattacaactttttattgaacattctgtatatcaaattgtttattaaaaaatgctttttttgaatcttgccaaacttttgcatgtataggcaacctatttttgcagctaataaacaagtatagttttaatatgaagattgcctggtatttatgttagtcagtgaagtaaaaatgaaatgaagaagctatatgtcagatactcatttatcagtgatgtaagcaattatttgcaaatcagaaaacagaatttcaataatgaaaggatttttaaaaaaatttttgtgctattcagtgtaatggctacaaacacaatacaccttgactgtttatctggtttattagcattttctccatcatcttcttaattctactctagaaaatcaagaagttctcatttgtagtgcttggagatttttatagtgtaaagattcccaccatcaccaatttcaaactactgatgtgaagttgctaaatgcagagttaagaagagattcacagtagttaaacaatgtgacatactcccaccatccagatacaataggccagatagaatagaccagcatccagaaagaaaagttgcacagtaatccagcagtaaagcatattactactgtcaagagagaataatccagagagaatagaccaccgtccagaaagaagagatgcgtgatagccccacagtatgccatacttctgccgctcagacagaatagacatatattgcccaaagagcataaataatagtaaaatacaggaaaataactaggaagtgatatgttttagtatttattacatttctttaaagtaagttatagaattctaagtttatatagtcaaatatttaataatggctgcttttaataacagactaacaggaatttctgacagtttaacaatgagaattggtatgggctgctttcagcacaccactgaattctctcccttaattttgttgtttcggaatgttttggaattggccctttttcctcctcaccctaaatactctttttgtatgacctcaaaaactgttctgacttcaacagatacatgtatgctaattattactaagtattcctttctagacaggcttttcccctgtttcagattcccacccccattttaaaaatctataggatatctgtatttaaacatttcacaggcctctcaaaatcattacctgccaagtcagctcctgctcctgtggttttcaattcactgctgacatccacgtggtagtcctgggctccttcctttctcttacatccaatatccaatcaatcaccaaatcctgctggttttatatgccaaatatgtcccgaatctgttacagctctagttcctaactagcattgccctgatcttcccctcctgacagggataccggaccggaatccgaaagtttttctgggtatggaactttctttacccctactcctctctattcacctcatccaacttatcctccatgtaccatggaggcatctatttacattgcaatctgtatatcttgttccctgcttataaccctttacttactcctcaacctgtataggatataaaccaaactccttaaggtaaaggccaatgctttccatagtctgaccaatttctctaaactcatctctcacccttgcctcttgtgtacgttctgcttgcatcaccgttctaaactggtttaaatttctatgcataacaatttttgctgccctcttggcctggcattccacccaaactcttttttactgatattttggttcaacccaggctccatctcttctaggaagcctctactgatctctctttctcaagaaataagccaggttagattgacttcttccatgctatcaaaatgaaccctatctgtcactttagttgccgtatctagttatattcatttatttctgtgtttatctacctaaccaaaacttaacataaattccctgaggaaaggaaatcatgtacagaagtgaatacatagaagatatgtaacaagggtttgatggacaaatgaatgagttaatgaatgaataaacctaaccatttttaagtacaattttcaaatttttgtagcggtatattttgtacatgaaattttaaagccagatttgtttttaacttagaatactggaaacaatttcatctggatcttctaatcaagatgactttcttttgaacctaatttcaggactttacactaattttctcaatattgtttagaaaggtgtatttcagagggtttttatcatagaggaattgaagtatcatagactagaaaaatttatctggcagaaaagaagaccgtaaaattcatttcatcttcggattttagttcattcattcattcacacatcaaatgaaagtggtttaaagcctgtggaggagactgaagagaaactggggattacagaagacacaaatacatagtaagctaaaactaactaacaagtattaagaaaacatcatggaaagttagaagatgaaggaaggcagcattcaaattaaatatatctgcaactggaagtataggtgttgaaattatttggttgagggagtatcacagagaacactttgcattaaatcgtgtattaaaaattttatttattctaaatatcaagatttaacatgcatgtctttcttgtcaggttgtgtacggaggttctcttgctgccaagttaacatagagtcagggaaaggaaaaatctggtggaacatcaggaaaacctgctacaagattgttgaacacagttggtttgaaagcttcattgtcctcatgatcctgcttagcagtggtgccctggtaaatgatctgacacctaagtcaacatattgattaagttgatattctttaaaatgaactaaaagataaaaatatcatggcaagttgttttacctagaattaatccctatgattagtgccaatgaaaaaattttacttgggctcagtaaatagttactgaacactcctacatgccaggcattatccttgctgcccagaatgctgttgtccaaaggaccacccagatggctatcatagaaaagagagttttactggcaatatcagtttgcaaaacagggagagagtctctggcataaactgaaagcactttatctgtagaacaaaaagagaaggttagaggttttattgaaaagggaaaatgttatgtattgctctttgagaaacttcattggccctagtaaggatttggggagctggtaagctccaattggcaagcaacagtggtgggcaaaattagtcctagagtgtagcaggtttcctcagaagctatagataaaactaatttcaagttacaacaagcagtttcaacagtcagtgttgccgagaattacaattcttggagtaatgttttgttccctgagagcttttcctcctgccttcttgactcttagttgactgttagttgagtatgtcaagaatgacccaatttgtatgatcaactttcacaatgcaaagataaatgagatccaggtagtatttattcttaaggatctaagagcaatggagaagagaagaatacaaatgagtaaatgtagaacttgcatgtgtttgtaagcaaagtgtatatgtgataaagttctgtagcaaggagaacaatcatctgcttgcaatttcagaaacgtaaatggtgcttttcagggtctagagagacgaataggaattttctagttaggcaaggcaggctgaggggaacaagtatacaatggtgaggaggcacaaaacagcatcagacattcaggaaattaaaagttgctgaactgtagcaagtgtggtgggaagaagaataagtacaggtggccagagatactatgagaaagataagcagggtcagcttgtgaagcatcttgtgagttataaaaagggaaaacagatggtagttttaggataaaaagtaggacaagtttctcatttttgtacacatacaagcagcttccatgggagttgaaagagatctggtagaattacaagcttcctgaacctttatcttaattgtcatttttcctgctggcgcggacagacatgagccattagaagcctttaggagcccagacccagctagatataccactggaagtttcattatactaaaaatagaatactcaagaactttgtaacttgccacaaagacagtcttcatgaatttggaatttgattttactgtacttagaggctaataggttgacctgttactgtttcatggatgctggcagaagatatgaggtgcttgggtcagagataaaggactttattacttatgcatggaaagtagcatgagtttcaacatatttctgttggttccccctttacccaagtctcatgagggcgttatatgagcctgaatgagtgtgtacacatatagtggattgatgttacagctgaggaacactgagcttagggaacacatctttttataccaagcaacataagtaaccctgccctttgtcccagagaccctacctcatgtctcaaggttgctcactgcaagcacaaccctgaggaatgtcccaggtacggagcaggcagtgtctggctttcttggcacactccccaacaacctgcagggacccactgtggctttcctctcctaacaagtctcaactctcagaaacagaaaatgtgatcagaaaagctctattgtccttatctggagttgtccaagtagaaatcttgatagtgtctaccatacaatgtattcctaataactaaggaagtttatcccatgctgactcacatatgtgactgagaatttcagagaggagattacaaaaaaaaaaaaaaaaattaaagaacagtttggagtaattccttgttcaaaatgtctaaaacagaggacaacatttggggagtgcattctcaaaactttattttaagtaaattgtatgaggaagaaaagggaaagatatttcaagaagctggtatttgtacttagagaggttgccaattaaactagattttttaaaagtatagcaaacccccatgacacgtgtttacctatgtaacaaaccttctcatgtaccctcaaacctaaaataaaagttaaaaagaagtaataactctcacttagtttatatttattgtgtttcagaaccttcttttaaatgttctcatttaattttcaaacaaccctgcaagattatggtattttgcttattttaccaatgataaagctgggtacagttttaaaagttgcttaatgtcccaaagccagcaaatgacagagctatcactgaattgatgtctaaagtcaaagtcaccatatcttttcactgtgtcatggctcctcagaaagaagagtacacacaaaatagaaataaatgagtggtaactgaatttagtaacagtaaagtgtaagtcctaaatcagatagcgctcacataaggtcattcttgcctcctcgctcctacatccacaaaattcattctggaagctagaacccctgtgggctgaattctaattcctgctctgggaccactcagacagaggttctcattatcaagacttcctgtgactctgctctgaccctgtacaccagttctagaaacaggcttctttttccttgtgactaagccccttccttgtctttgtatttaaaggactgagtcattgccatagtttctgtttagatggcttgcctgattcctccagaacttgggggtggagtggcagggaggaaaatcctgagggatagaagcctccctctgcacttcaattccattgaatttcagaacctctgccaactgctgggaccttctttttgcatcttagtaggtctgttcagtctttctgccccaacttgtctcttttcttcaatattgataccaacagtttcccaaaactgctaaggataattttagagtattgatagcggaacttagaataagaagaatctgaatggcacaagttcgttagtatagacagtcaataaatataatattattcacgaaggatacaggtctttgactttcattttatccaacagggttaatggtgtttcaatcagaaagagaaaattctaacactttagacctgttgagatcagcaatcattttcagtgtctcaatgagccctttttttttttttgagatggagtctcactctgtcccctaggctggagtacagtggcatgatcctgactcactgcaacaatgagcccaatttttaagtccattcaaattctttgtcaagggacatgtggctgaagtccaaagtcaaagtcaccctatcttttcattgtgatgtggctcctcagaaagaagagcatacacaaagtagaagtagatgagtgataaccaaaattagtaacagtaaagcgtaagccctaaatcagatagagctcacctaatgtcacataatattgttgtgtgtcacttactaaaatttcttggaaagcataggaagtaccgcattcatggagagaatcgaacagtgattttcagagctgaagctttgaaggataatacatggatagactgtcaaaggaaaaagcacgctctgtgttctataggcctattaagctactgcagtcattcgtttagcaaacctttcctttcgtgctgctgttattaacatggtgctaggcactgggatgcacaagcatttgagaactaagagaggctccacatcctactggtggggaaaaaggggagtgtaggttgtgaaaagtttataacaggggctgattatgggatcatgtcttaaattgttaggacttatccaattttaatggagaaagaggaggaatcagatggaggtggaaatgatcaggtgtcagagatcatgagtctttttgtggattacaagtaatttcattcttttgcactttctcttgacctctgatgaccagcagcagcactggtgagaaggctagaactaagtgttatgtggtaactgtaaacccgaaaaaatgtcagctggcccatgtcaatattatgtttcagtgttcttagcattagaattgtatttttcctggttttgtatgaatcataaagcttaagttgtgcatgactgaaacttgaatattatttccacaggcttttgaagatatatatattgaaaggaaaaagaccattaagattatcctggagtatgcagacaagatcttcacttacatcttcattctggaaatgcttctaaagtggatagcatatggttataaaacatacttcaccaatgcctggtgttggctggatttcctaattgttgacgtaggtacttttgagtacattttaaaagatttattcttactgagtgttgtgaaaaaaccttcaccagtgttgtatattattatattttaattttgttaagcttcatatactttcaggttataggtttattcttttagaaatattagcacagccagtggaaatatatctgtgaggcatattagaacagaaatcattcaacaaatataaattatttctgtgacatgctaacatttataattgagttttttatgttttctgcaaaggagatgtgatttaaaaaatatatatatatatgatttgaatgtcattcctgttaagaataaaacaaaatttagaagtaggaggtgataagagaaaagggcagagacacagattaaagagaggaaatgatgactattcacaatataaaattggaagataagagaggatgaggggtatatcgagttggctgatatgtgagctaaaatttttctaatttaagtaaagttaaactttgtattttttaaagttaacttcgtttttggggagggcgaaggcatgaaattttaaaatatctatctcagacccaattataggaaaaaccaaaacgagacacaattgtctctatctcaaatatgcaacttgcccttcatctccagaatggcagtggggcagtggagtaagcattattattaatgtaataattttacataataaattaaaagaactgatgaatacttgcatgatggaaaatacataataattctttagtttacatataagcctgtaaaaaaagcacaaatatttttacaggcttctgactgagatagggaataaatcttaaaacagtcggtgagatcaaggaatctcaaatagaaactgatggtacaacacccattgttatcatttcattgaatatactctattttatattttaataatataatttaataatatatatgacatattttgtattatttaaaatggcgttcttacattattttataacctcaatctcccagtcttatttttctcagaaggatatgttctttatcttttactaattcttctagatattcagaaacctaacctttgtgtttagggaagaaacatcctataatcagtcacactttttagagatttgtttacatataatgcctgacataattaggggtcaacacgcaagtttttatatgccaataagtgctttaaaatttaaccaagggtttgcattattgagcttttaagaaaagttgaattcatagagcatcatacgtggattagaaaatcacaagtaagcatgatcataaatagtaaaatctgactgcagaatgttacccaaattagtcatatttactcaaaagttcagtttctcaactgttatttaaagcttcataaacttttggcttctggccaggcgcggtggctcacgcctgtaatcccagcactttgggaggccgaggcgggtggatcacctgaggtcaggagtttgagatcagcctggccaaaatggtgaaaccctgtcactactaaaaaatacaaaaaagtagccggacatggtggcaggtgcctgtaatcccagctactgaggaggataaggcaggagaatcgcttgaacccactaggcagaggttacagtgagccaagatcgcaccactgcactccagcttgggcaacagggtgagactccatctcaaaataataataactttcgttttcttaataacttgttttctataatatgtaagttatgtgaaaaaattttttaacatagttatatattacacctcatatgtgttatcttgggtttcctctgtgagaactctaacttttgatatagtaatgatttcttgtttttttttcaattaaccattcatgtatcaagttatctagttattgcctagaaaatgaaaaatgataaaatggatatttttgtaatatagtagttttaaagaaaggctgccccaaataagaagaaattatagaaggaatgtaggttttccttttctcttaaactgtaaatatgatggggtctttctcttaaaaaattatacaatattttagatattttaaaatctttaaaatattatcacaaatatactcactttcatcattcagtgtaagagataaaggtttacaagtaaaattgaacttattttaaattaagagatatggctgtttaataatggaaattgttttatatttgaaaatttaaagtgataattctcaatgagtataacatcctgttcagggatatgtgtgcagaaatcagggagataaacaactccaatttgaaatattatttaatattttggaaacaaacaaatataatgcaaagtacagagagtaaagctccacacaatattcttgctgatatagatgcaaatttcaggacgcagatttgggggagtggctgactttttttttcctgaaaagtatagtaacttatctacagcagttgttctccaagcatggtctcaaaactgaaaacgttggcacatgtaggtgagaactcataaggggtgagttcctccaagacctactgaatcagaaactctggggttggatgcagcaaatcgttgtaacaagtcctacagatgattctgttgtatattcaggttacagaactacttatattatttgctactcagagaatggacttgtctgatttctgcaggcttctgggttatttgaaacttacttgattaaacagtgttcagcagtgcaggcacatatttgtatatatacacatgtgtttatagaaagatatgaatatatatgcatatatattctcagttacaaactataccgtggtcttcttaataatatacatatattccatgtcataaaactcacttaacagtggcttggagaacagacctatccgtattttaggggctgtatcaattatagcagacatgtcttagtctaccttttactgctgtaactgaatacctgagactgggtaaagtattcactaaagaaatttatttcttaaagctctggaagctgggaagtctaaggtggagggtccacatctaatgagaactttcttgctggtggggacactggagagtcctaaggcagtgcagggcatcacatggcgagggatgttcactgacagccaaactgggttttataataaacccacttttgtgatatctacctcactcccgtgataacccattaagcccttactccatattccattcatgaaggcagagcctttatgatctcatcaccttttaaaggctctgcctcttaatactgttacattgggaattaagtttcaacatgagtttcagaagggacaaacattcaaaccacagcaaaacattttaaaattttgttttttttctgattaaagagggagcatacatattttcaagtgttcttaagtggaaaataatggatgtgaatgactgggcaaatttaagagtggcatgaggagcaatttattctgttaaatatatagcttaaggaattaaagcagtattacatttagtgagacatttggaaataccacatgaggacgagtactttaaaacacctcctgcttcataaatcagtttacctgtctctgatggtaacagcaatgaacttgttgtgaacaatgactttttctactcctgaaatagataaatatataaaaagttggctctcatgtgttcctattcttcccttgaaaacctgaatctctcagtcactaacttaattcgtaatgaagaactgcatttcagacatttttcttagacatcgtctcctgctacacaggatgtgaggcaaatgaatattttccatggaactaattcagagagtaaatgcatttatagatccagatctaagatcattgaggagctcattgctttgtaactaaaatgtgtattgattgtattgctgttcatgttctttcttaagataatttacggtaagaactcaaatttcttttggatactggttatggtaattgtggctgatctatctaacatgatgaagttcttattatatctatattgattgtgaagccaaggagatcagctactttcattctctcttcagtacaattgtgatttttctcccatgaaaaattatttggtagatctttggtgccaatcctgagaaattgtagggcagaagcaatcttgttgagaatttgccccaactcaaaatcatgagtctacaaaatgttttttaataagatgtataccaaggcatcgatttagttgagtgaataccacacttttagggcttagcttcagaatcacacacttcactttgacctgagttttataattaaaatgttgaccattgttctaatgaaatcttcagatttaataagcaattacaaaacaattgattacaaaagtgtgaaaagcatatgcatgatttctactcaaatagaataaacaacttactttgcttacattatttcttcttattttggttaaccttcttttaaatctatttccttatagaaacatccaccttaccctgtttttaggcattgactgtacaactccatatataaaatcttattgttcctgttgagttgcttttagtgagtttcaaaattgactttttccttttatgcttcatcattttattgacacaattaatgaaaatgctatttttataggtttctttggttactttagtggcaaacactcttggctactcagatcttggccccattaaatctcttcggacactgagagctttaagacctctaagagccttatctagatttgaaggaatgagggtaagaaaatactaaactttataatattcttatttttttaatggggtttaaaatataaaaacaatgggtgtgtagaaattatgagtggtttctatttacataaatatgtgagctgtttatgtatgtgagtgtacatacatatacatatatgtatgcatatatgtatacattatgtatataatagtatgcgtatgtatactatatatagtatgcatttacatactatatacagtatgcatatatactatatatactatgcatatatataccatatatggtatatatatgcatattatatatactaatagtacatatatgcatgttacatatactaatagtatatatgcatattatatatgctaatggcatatatatgcatactaatatataaatgctaattatagcattaattaaacagtatactactaaaatagtataatactaattagtatatactagtatatattaatatataccaaatatgaaatactatatataaaatatgcatatatagtatatgtatatatcatagttactgtacatattagtgtatatatatgcatactacatatatatatacacacacacagtatttcagcacatattgtttaacaagggaataagttaatcacagtaatcctgcctttatctaatattgtcaagcaatagaatgatccaaatgagtgactttttccatgttaaatggaaatcttccctgtgctaggaagtcccagtgaaaggggaaactattagtcctaacgtcatctctcatacataagtaatcaaggacctatttatatcaggtgttcaaataatatttgtttaaggaactacctgggtaaggagcattagaaaagatagggaagtgagaccacatcagccatcacatttaatttcacctttaaaataacattacaaagtaagtggaattataactaaattatatttgagaaaactaaaggtcacagagtttacttgatttgcacttaggctgcagagtgcctgaaaagatactcaattagcagagacaaacaagttataatgaataacaactaccataacctagctttagggattgtattaaactagcaactttgtaacacacatgaaggacaactttattttctataattagtccatatcctcatgtgttggtactcttctaaaatttcttccccagatttatacctgcttttttatgcctctgttctgaaatgcttcccctgccctgccccgaccctaacccgtctgtacagcaaacacctatctgtcctttaaggctcaatttaaagttgccttgtctgtccaccagcagactaaactgcatattctctctctgttcagacacctaaaatcctcattatattgtattttacttatttgtttacttaactacctccctaccttaccatctctgagcaatttaacatggagattagtctagcttactgatattttaagtgtggtttactaaccagctattagcattatctacaaacttgttaaaaagatgggcggatcatgaggtcaggagttcgagaccagcctggccaatatggtgaaaccccatctctactaaagatacaaaaaattacccgggcgtggtggtgctcacctgtagtcccagctactccggaggctgaggcagaagaattgcttgaacctgggaggcggaggatgcagtgaactgagatcatgcaactgctgtccagcctggacaacagagcgagactctgtatcaaaaaaaaaaaaaaaaagcaaattcttggatctcaccccagacctactgagtcagaaactccaggatggggacgaaatttgggtgaacattagagatctttcagcctaccaaatcttcactgttacccctacaaacctaattatgactgcaatctctgctattttaagtatccagtgtataatggcttccaagtatgtcagaaagaacatgattatataaaaagttcataagcacaattcaaaaatattctatctacaagttgaaaattacaagtttcattttgtgcagaaaggtggtattagaattcattgacattaacttaattttttgagcattaatagaatgctacaatctacccagaactttcccctacaaaatcacttccttcagtgactaaatcagcctattattttactctgtttgcactttgttctttatctgtattacaggtgaattggatgcaggagaatagtttagtatattttgagggacaaatgtctatttagttacatttgttaaccatgcaaaaagagacatttcttcatgctgcagggctattttgaaggataaatgaaataatgaaataatacatttgaggcatattgtagttagcttgagtccttaggctctttagctttcccaactggcttctcatcagaccaatatgtgcctgtgtttctcagagacccatgattccaacattactcatgttttttgaaaaacattttaaataccaactatgtgtcaggtgttgtggtataaaaaacacagagtacagtggtacatagaccccagtccccaaagagtgagcagagtcaatggttacaagagagacagacaagggcacataatgatacaggaatatacaggagggagtggctatctggggaagtctgggaagacatcacaaggaggtgacatttcagatatttcatgactgaagagtaagccccaaatcataggcagataggcattcaaggcagagataccacatggtagggcagcacagaacagagtgtgcaaggtgtacgtggtcagtgactagacagatcagtgtgcctaggtgataaacgtagcagggagggcagcaggaaatgagcatgaaaaagtagactctactaggaggtggccactttgaacttcattctctattcctgttcctcctaatcttttttgaggtcacatggactatgaaaatctcatgaaagtaagaattttctttccagaaagagagcacaaccataatgtttgttatgtaatttcatgcccccagggaacctctacaggtccatgaactccaaataatcattgctctggaccaaaggtcaacaaaccccagcctgtttttttcttggaacacatccttaccagtttgtttatatgtgacctatgactaccatcctagagttgagtagttgcaacggagatataacccacaaagcctaaaaatatttataaaaatgtttgcaaacgttctccctagatgatctgattagtagtcagagatccttagtatttctctattttaaagcatcctgagaacctgcttaatacattgcagaaaagaaggatcccagtgctacttccctaacaggttaatctttaacacatttgtacttgaatgggaactctgaagtgaatgggagctgaagtgtgagaagacaggtagattttaaaggattaagtaaatgagaaaatctggagagtgttaaatgctacagtaattgccctggaggaaaactggagtggcaagacacactggtgatcaatagcagtacaaatgctgaaaagccgaaataaagaaaggattaaagaaaaactgttcctaatttttgccttcactgaggtcagcactatctatatttagtcaaaggcttacatataaagtatttagagtaataataataaatttaagaagattgctcttattttgtagaaccagccaaatctaaaggattcaaaccatttaaagactcaatccttttgtagagaagaatgtctcaaaaaaagagagtaagaaaataaaataacaaaattaaattaaaatgatgtccagtcataattccacctgataaacactaatagtttctctatgggggaatctttaatgctggtaataataggatcatgaacatttaaatgtatataaatatatatttttcatttatgtttataaatttcttttttttccagagggtacagattttacaagtttaccttatcaataacaggttttggtttattatttttatttattttacatttatttaagctattacattatcttagttattttgtcttatagtttgctaataattttattgtgtgatagtcatgtaatttgtaagcctggtgatcacagaattcctgtctcattttgtcttgcttggcacactgctgagtgtagagtaggcatttaataaacgtgtcggttggtttggtgtcttagatatttaagggtggcttttctaatttgtttatgtctgcatggcatttctttcatgttgcctatttaacatcttactaatcctaatcattcttttctttcttttgaatacaaggtggttgtgaatgcactcataggagcaattccttccatcatgaatgtgctacttgtttgtcttatattctggctgatattcagcatcatgggagtaaatttgtttgctggcaagttctatgagtgtattaacactacagatgggtcacggtttcctgcaagtcaagttccaaatcgttctgaatgttttgcccttatgaatgttagtcaaaatgtgcgatggaaaaacctgaaagtgaactttgataatgtcggacttggttacctatctctgcttcaagttgtaagtgtcccctttcatgaatgcttggtattttgatagatattggacaaaggatataagttattctttaaatagtctgttaattataaattgaagataaaatactgtatggtttttaaaacagtgccagtcttggccaggcttggtggctcatgcctgtaatctcttcactttgggaggccaaggtgggcagatcacgaggtcaggagttcgagactagtctggccaacatagtgaaaccccatctctactaaaaatacaaaaaattagccgggtgtggtggtaggctcctgtaatcctagctacttgggaagctgaggcaggagaatcgcgtgaacccggaaggtggaggttgcagtgggccaagatcgcgccactgcactccagcctgggctacagagcgagactccgtctcaaaaaaaaaaagtgctggtctttcctagaacatgttcctacatgaataagaagcataggttctgttgcatttgagttattaatttataattgactctttggtgtcatgtggactcccatcttgtaccattcaaatattgcttcaaaaatgaacatttttggacttcctgcttcacactatgaagggatgagaggaacttcccacaggcgtggagaacccttaaaaaaatgaagaaaagatgtttcctgtcttattcataaaagttcccttcacctttaaaaaataaaaggttatgtgcaaaattcacaggcaaatgtaacaatttggaaataattaactagaactaagatttagcatgttacttgggaatatgtccttttaaaaaaaaatctttatattaaatggacatgttgaatacagcaaaacttactagtattgcttagtaattgtggtaacattaaacagacaaaactatgtttatggctattttagaatatgagtttaacattcagattctattaatattattcttaaaggcaacatttaagggatggacgattattatgtatgcagcagtggattccgttaatgtaagtattgattatcttagcactaaactttatttttgcaagcttctgagtttatttcagtgatttccaaactataacttcatgaagcccttgggactcacacagacaatggagaacatccacctgatagtagcctagtggttgtgagtacagcagttggagatagaacccgactcaaattttagctgtaccacatcatccaagctctacggctgactttgggcaaattaccttaccttcttgagacttagtttatttgtctaatctataatttaatgaatctatcctttgcctaataaatgtctataatcatccaatgcctactccatagtgttgtgaggacccagcaagaaaatagaagcagagcacttagtgcaggctggcattactaaatgctcagtaaatattcgcttatcagataaaaataaaataattataatgtataacttttactctttttacattttaaaacaccttggatgagtttatgtgaaataagttccatgctaagaaactttaatgattactccctaggttatatttttacaaaatctaataaagacatatttggaatcaaatgaaaatacatggcaaaatttatataaatatgataatgtctcatttacagtacttttggaaataacatatacacagtatgtcacttagtttttgaattgtcctaccaatatgagcacaagtatgcatgtgattaagccctttgtagttatttgaagattatattatttattacataagtatgtaataagttaaagaagtatgtaatgaatacacattgaataaattgttaagagtgattatgttaaacctcaacaatgctatagctccttaaatcctgtttacctaggatagcactgtttgaattaccttgtcagaccatgtgaaaaagaaaatgaggaatgttattgtctatataatgctaacttttgtaaattttataggtagacaagcagcccaaatatgaatatagcctctacatgtatatttattttgtcatctttatcatctttgggtcattcttcactttgaacttgttcattggtgtcatcatagataatttcaaccaacagaaaaagaagataagtatttcaaatatttttcattgcaatgaaagggatgaacaattattttccaaaaaagataatgtaaagtttaatttgatatcaattcatgattagttttattagaacttcatttatttttcaaataattgactagtatacaattacaaatatacttaatctcattcatttttgcacagaaaacaattttctaaataataggttctggctaacctatgatttaggttaaacccataggttttgagcaatatatcaactattctgttttttccaatgtttcctatagaggattgaataattttaaaaaatcaatacactatttattcaaaacacattttataagtagctatttattttattctgtgtgatacatactgggttggagcttgggggagaccaacataagatagggttcctgagctcaaggagtttatatcgtagcagaataagtaatacaggtactgaaaattaagatttgatgaatactgtaatttgggcaatcttctgaaatttttaattaattaatcttcacatcaactgtattagtttctttgacctgtgagaacaggataatacaaacctgatgacttaaaacaagagaaatgtattctctcacacttttggaggttagaagtccaaattcaaagtgtcagcaggtccatgttctctttaaagcctctaaggaagtacattttattgcatcttccaacttttggtagcccaggtgtttcttggtttatggcaacagaactccaatctctccctttttagtgacatgccattttccctctgcgtgtgtttctcctctactagtaaggatgtccgtcacactggattaagagtcaactccactccagtatgacttcatcttaattacatcttcaatgacattattttcaaataaggtcacattctgaagtgctaaggcttaggacttatatgtaccttcttggggcacacaattcaacccataacatcaatcacaaaaagtattattacagagtctatttcataaatgaggaaaggcacagagagattaagtgacttacccaaggtcatatatcgagtatgtgatgaaggttagatagagtcagtagtaaattcgatgtatcttgtactctattactttagactctctactatgctctatccccaaatactataataatgataaatacaataagaaaaattagcaagaacaaaaaatgtacatgacagtcggaataaaaatagatgctgctatagaatagtttatgaaatatgtgacaattgagaaggctttggaagatgggtaagaagatatgcagcaactgagaggcaaaagaatggctaacccacatggagggaaacagaaatgagtgaggaaatgaattgtgttgataaaagaggcaacaattcaggggggatagcaatgccttcagttttgaagaaatttaagatttggagaaatagtaaaagatgaggttttgacctgcttgagagtagatataaaaagccatattagaccttttttagtagcagctggtgtttcattcatatatgttgagtagggaagaacatggaagcaggagattgatgtttattaagactcaatgatatgtcagatcctgtgtaaaatacttctaatgtaattgtagtcaaattttacaacaaatccaaaggacatagaatcctcatttaacctctcagaaaaattttcttatttgcacatggcctgacagctaaaacgtagtttcattatggatctagctccagaattgctttttctagagtctgagacagagctttaaaaaaaaattaatctagcagcgatgcccaaaatgactagggaaagaccaaagactatttcagaccctgcttgacctgccacctggcccatacttactctccaaattagtcctgtgtggcaatggagaataggaaatatattccattaaaacattttagagggtagaatctacagtattgcttgtgatttgcaagagataaaggagtctaactgtggagtttcttctcaactaactgagatactctggttgtagtaccacctatacaaaaagagacctttggagactaaatggtagaattacaagagaataatcatttcgggtactggcttagcatctaacaagacagatgtacatgtatcgaaatgtcattagtgtgtgtgattgactattcacacgtagacaaaaatttagtaaatattgcattatttaccctgacgtttccaaatacagatgtttatttttaaagagttttaaatctcatgttccattttacattttataaagtataccctgattttcaattgatttttctcaacttaagcattatatatacatacatttaatatataagcacacacaagtaattcctcagtcttccctgcataggataaattaaatgcatctagaaagagcagtatgagtatgaataaaacagccaaagtccaattgactttaatcttcctgcttgttaatgttattcttacaacatttctactgcaggaagtaaaatagaatgggttgatactatcaccactaaagtcaggaaagagttactgatttagaagcatcaaaaactcatatcccctatcattcttccagtatttcatcttgaaatctaagtatagcatttattttctgaccttttctgaatgatttagaaattctttccactcttccttgaaaaaacatgaccaacacttcaattagttaacacatgctattagaagtaggtagtagatgctttgtgatgaactcatttattcgatagaagaaaaaaaatgaaagtggtatccttttctttgcctttcctatttttaattattgtggtaaggacacttaatatgagatctacctgcttaacacaatttttaagtatactatatatattgttaactataggcatgaagtaccgcagcaagtccatagaacttattcattttgcataattgaaactttattcctgttgaatagcaattctccatttcactatcctttcatgccctggcaatcaccattcttctctctgtttccatgagtttgactattttagttacttcatagaagtggaattatgaaatattttttctgtgacttcatttagcataaatttctccaggttccttcaagttgttgcatatggcaggatttccttttttataaggctgaatactgtgtgtgtgtgtgtgtgtgtgtgtgtgcgcacacacacacgcacacacatgcaggtatacaaatatcacattttctatcccatcattcatcaatggacatttaggtcattttcatatttggatataataagtagtgctgaaatgaacacggaagtgtggcccctgagatcctgagttcaaatttttaaaatatgctcagatgtggcattgctagatcatatggtagttatatttttaattttttcaggaagtttcatactgttttctatggcagctacatcattttacattccaacaatatacaagggttctaatttctccatatccttgccaacacctattatcttttgatttgggtggtttttggttttgtttttggtaatagccatcctagcaggtgtgagatgatatcccattacaatttctgtttgtttgtttttgaaggagtctcactgtgtcacgaggctggagtggagtggcgtgatcttggctcactgcaacctccgactcctgcctcagcctcccaagtagctgggactataggcacgtgccaccatgcccagctaatttttgtatttttagtagagatggggttttaccatgttggccaggatggtcttgatctcctgacctcatgatccacccgccttggcctcccaaagtgctgggataacaggcatgagccactgcacccagtcctcattacagttatttgaattttctgatgattagtgatattgaacatcttttcatatacctgttggccatttgtatgccttcttaagttgtaggagttccttatatattttggatattaaccatttattagatatatagtttggaaatattttctcctattctgtaggttgctttttcaccctcttgattgcttccttttttttttttttttaccaaagctttttagtttgatatggtctcccttgtctatttttgcttttgttggttgaatttttgagtcatttccaagaaatcattgtcaagatcagtatcatgaagctttcctgctatgttttcttctaggagttttacagttttcaggtcttaggtttaaatgtttaatctattttgagttgatttttgtgtatggtataagaaaagaattcaattttattttttatatgtgaatatccagttttcccaacatcatttgttgagtggcgtcttttctattgtgtattcttggcacccctgttgaatacgagttaactatttatgcatgggtttatttctgagatctctatcctgtttcattggcccatatatttgttttatgccaggaccatactattttaattgttgtagttttgttatatattttgaaatgaggacctatggggactgggtgcagtggctcatgcttataatcacagcaactggggaggctaagactggaggatcacttgtggtggagagtttgagaccagcctgggaaagatagaaagactccttctctacaaagatatttaaaaattagccaggcatgatggcacacacctatactcctagctacttaggagcctaaggtaggaggatcactcaagcccaagaatatgaagctgcagtgagctatgatcatgccactgcactctggcctgggcaacagggtaagatcttatgtctccgtaaataaataaataaataaataataaatgagaaaatgtgattcatccattttgttcttttttcttaagattgctttggctattcagagtcttttgtagttccatgtgaattttaggattttttttaaattttagtaaataatgctgttgggattttgatatggactgtattgaattcacagatcacttagggtagtgtgggcattttaacaatattaagtcatttaattcatgagtaccagatctttctatttatttgtgtcttctttaatttctttcatgaacattttatagttttcagtgcgtacattttcaatgccttagttaagcatatcctaagtattttatttattttgatgctatcataaatgggatttcttttttaattttcttttcagattattgttagtgtatagaaacacaggtgatttttgtatgttgattttatatccttcaacatttagtaaatttgtttattagttctaacagattttcctgacgtgtggagtctttagggtattctccatataagataatgtcatctgtaagcacttttttctttcaggttgggatgtcttttacttgtttttcttgcttaatttctccggctaggacttctagtgctttattaaatacaagtggcaagagtaggcatatttgtcttattcctgatcttacaggaaagtttttcagtttttcaccattgaatatgatgttagctgtgggattttcatgtagtctttgttatcatgaggtaaatttcctctgttctcatccatttgtgctactataacagaacatcacagactgggtaatttattatgatcacaaaccttatgggatcacagtactggagaatggaaaattcatgattgaggggctggtgaggtcttatttgttgtgtcataacgtgctgtaaggtatcacatggcacaaagagagaataagtgagaaaagggggcagtacctgcctgtttataatgaacccaatcctgagataacagcattaatgcatttaaaagggtaaaattctcataacttaaatacctcttaaaggtcccacttcccgattctgtcatgatgtcaattaaattgcaacatgagttttggaggggacaaacgttcaagttatagcaacttctatacctagcttttgttttcttttttagcttttaccatgaaagggtgttgaaatttgtcaaatgcttcttctgaatctcttttgatgatcatgtgatttttatccttctcagatcatgtggtgtatcacattatttgatctgcatatgttgaaccatccttgcttgctatcgtaaatgggatttctttcttaattttcttttcagattattgttagtgtatagaaactcaggtgatttttgtatgttgattttatacccttcaacatttagtaaatttgtttattaggaataactcccacttggtcatagtacatgatcatttaatgagctgttgcattcagtttgctaatattttgatgaagttatttgcatctatgttcatcagggatcttgccctgtagtatgcttttttctttctaaaaatttgctcatttataattgacaaaaactgtgtttattaatggggtacaaaacaatgttttgatctatataaacattgtagaaagattcaatcacgctaattaacataaccatcacatcacccacttatcatttttttgtggtaagaaagttaaaaagttattcttttagcaattttgaaatatacaatacatttatttttttcatttcctaatgtgtgacttttttgacttttaagttcaggggtacatgtacaggatgtgcaggcttattacataggtaaacgtgtcatgagggtttgttgtacagattatttcatcactgaggtattaatcccagtatgcattggttatttttcctgatcctctccctcctcccacccttcatcctccaataggcaccagtgtgcgttgttcccctttatgtgtccatgtgttcttatcatttagctcccacttataagtgagaacatgtggtatttggttttctgttgctaccttagtttgctaatgaaaatggcctccagctccattcatgtccctgcaaaggatatgatctcattctttttaatggctgcatagtattacatggtatgtatttaccacattgtccttatccagtctatcattgatggtcatttgaggtgattccatgtctttgccattgtgaatagtgctccaataaacatatgtgtgcatgtgtctttataatagagcaatgtatttccttttaagcatatacccagtaatgggattgctgggttgaatggtatttccgtctttaggttttgaggaattgccacagagtcttccattatagttgaattaatttacactcccatcaacagtgtgttagcattctttttttctccacaccctcgccagcatctgtgatttttgatctttttaataatagccattctgactggtgtaagatagtatctcattgtggttttgatttgcatttctctaatgatcagtaacgttgagctttttttcatatgcttgttggttgcatgtgtgtcttcttttcagaagtgtctgttcatgtcctttgcccactttttaacaaccatggggttgtttatttcttgtaaacttgtttaagttccttatagattctggatattagacttttgtcagatgcatagtctgcaaaaattttctcccattctgtaaactgtctgcttactctattgatagtttcttttgctggcagaagctctttagtttaattagatcccatttgttaatttttgtttttgttgcagttgcttttggtgtcttcatcatgaaatccttgcccatgcctatgtactgaatggtattgcctagattgtcttccagggtttttacagttttagattttacatttaagtctttaatccatcttgagatttattcctctactctaaatgaaaactgtacaccctttgatcaacatttctcctttcttcacatcctcttcctccagtcctatgataaccacctttatacactgtttctgtgatgttgactttttaaaattgtacgtgtaagtgagatcatatgatatttatctttctgtacctggctaattttgcttagcataacatcctttagttgcattcatgttgggatgaatgacaaaatttgttcttttgaagttttgtatagtagtccactgtgcatacctatcacattttctttattcattcacctgttgatgggtacaggttgtgtctatgggttagtgcaaaagtaattgtggtttttgccattattttaattgcagcaaaagtaatggtaaaaactgcaattacatttgcagcaacctaatatgtcttggttctcataaataatgctgaaatgaacacgggagtgcaggtatacctttgacataaggattttaattccgctaaaggaattaaatatatactactatgtacctagaagtggaattgctgaattatatggtaattgtatttgtttttggaacttccatgctatttttctcaaacagctatcgtaatttacattttcactaacaatgtataagggttcctttttctccacatcatcatcaacacttgttatcatttgtctttttgataatagccattctaagaggtgtgaggtaatatttcattgggattttaatttgcattttcctgatgatcagagatgttgagtattttttaatatatctattggtcattcatatatcttcttttaagaatgtctgttcagattatttgcccattcttcaattggtttattgattttctaggtgttgagttgtttgagtttcttgcatatgttagatattagccctttatccgatgtatggtttgcagatattttatttcaatccatgagctctctctctccactctgttaattgttttgtttgctgtaaagaacgtttttagtttgatctaatccaacttgtctctcgttatcttttgttacctgtgctttgagagtcctagccaagaaatccttgcccagacaaaagtcatagagcttttcttttatgtttccttctagtagcattatagtttcatttcttatatttaatacttttacttgtttggatttttttaaaatgtggtattataaaagggtccaatttcattctttcgcataaggaatattcagttttcccaacaccatttattgaagagatcgccctttcccccattgtttattctttgcacctttgttgaaaatcaattgactataaataattgggtttatttctgggctttttctcctgttccattagccaatatatctgtgtgtatgccaataccatagctttttattttgaaatgagagaatattgtacctccagctttgttctttttgctcagattgctttggccatttggcatcttttttattttattcaaattttagcatttttgactatttctgtgaaaactgacattagaattttgatagagattgcattcattttaacaatattagttcttccaacacatgaacatgaaatatattacaattgatttgtcttcctcagttgttttttttttttaaatcaaggtatagttttcagtatacagatctttgaccttcctggttaaatttacttcaaagtattttatttatttattttgatgctgttttaaataggattaatttcttaatttctttgttggaaacctcattgttaatgtatagaaatattactgatttttctatgttgattttgcaaactgcactttactgaatttatgtatcagttttaacagttctcagtacagtgttcagagttttctacatataagatcatgtcattagcaaacagagataattttatttcttgttttcttacatggatgtcttttatttctttttcttgcctaattgctatggatgggacttctagtactatgtcaaaaagaagtagtaacagtcaatatccttgtcttgttcctgatcttagaagaaaagctcccaacttttcacagtttttgtataatattagctgtgggcttgtcatatatggctttattttgttaaggtacattccttccatatctattttttgagattttcttatgaacatatgctagattttatcaaatgctttgtctgcatctagtaagatgatcatatgatgtttgttcttattttgttaatgtagcatatcacatttattgatttatgcatgtttaaccatttttgcatccctcagataaatcccaaataatcatggtgactgattttttaagtgtgctagggaattcagtttgctaatattttattgaggatttttggatctatgttcatcaagaatattggcctgcagttttcttttctggtagtatactcttatggttttcatatcagtgtaatgctgtcctcataaaatgagtttgacctcctcttcaatttttggaagaatttgagaagaattcatattacttctttaaatagaattcaccagtgaccttttcctttttttttttttttttttttttgattggagacttaatttgttactgatctattttctttatctagtattggtttgttcaaatgtaatatttcttgctgatttagtcttggtaggttgcatgtttctaaagattagttcatttcttctaggttattcagtttgatggtgtatggttgttcacagtaatagtttatgattccttgtatgtatgtgttatcagtgttagtctcccttctttcatttcagatattgtttgagttgtcttttttccctttgttagtctagttaaaggtttttcaattttcttttttcaaaaaaacaactttttagtatttgctttgtttatttctatccttatctttgttattttcttccttctgcaaagtttggggatattttgttcttctttttctaatcactaagatgtaatattaggttgtttatttgagattgtccttctttctttaatgtaggcaattattactaccaatttttctctcagtgcttctttttctacattccatactatttgttatcttgtgtttccattgtcattgatctcaaaatattttctgcttttccatataattttctctttgacccattggctcttcaggagcatgtcatttaatttccacgtaattatgagttgttcaaggttattcctcttattgacttctagtttcatgtcatcgtgaacagaaaaggtactcgatatgattttaatcttcttaaatttgttaaagcttgttttgtggcctaacatgtgatctatcctggagagtgtttcatgtgatttgagaagaatttgtattttgttgctgttggatgaactcttctataaatatctgttaggtccattggattaaagtgtagttcatgccttcctgtaatgagagactgcagaaattatgtcaggagtaagccagggaagaagtcactctcctattcttggtggtagagaccttccacctctattaaaagaaagattgtagagttgggattgtctctgtaggaagccagggaagaaggctgggcaatgctattcctcttgtttaggctgaagaaggtttattcttcatttgctatgtagatttccaagtactggaagaggccagaaccacagggagcggctggaaaatgtgcagcctaatggtttctatgggaaagttggaagatggtctgatcccaggaattaaagcttctgaaagggctcaggcagttcaacaccccccattgttctttgtacttcagagaaaactccaatggcttatctctgccatttcacaagcatggtgatctaaaagccaaactctgttgcagggactataaaagttgggttctacaaaatggaaaactaaggcacttatgaagatgattgtataatatagttcatatcttctctctttccactctagaaaaatcattttctagaaataaatacatttcctcaaattaaaaaaaaaaaaaaaaaaggttgtgttctatatgtgtgctatagcttctcaacccttgggaagcagctgcaaattcagttttcttcctaaatgtaaggcactgtgctcagggtggggttagtgcatgagtgtctttccactttttctacacattttgatatggatattttctgtcctctggtgtgtttgagtttttctactggattatgggtttctctgcagagaactgatccatatgtatgtagatgtttacttggtatgtccgtgagataaaaaaaatagtcataagcctcctatttcacaatgttgttaagtcacttccttcaaaagttgtaattttcttttcttacggtgtctttgtctggctttggtatgagagtaattctggccccataaaatgactttcaaagtgttctctcctcttcaaagttttaagagtttgagaagaattaatgttgattcttctttaaatgtttggttagacttctcctgtgaagccatctggtcctgtacatttcttttttgggagttactattattattattattattattattggttcaatctgtagcatatcctgtgtgtttgttatccatttggtctatagcgttgttcaaatccacagtttgtttatacattccatgtctggctgttctgttcattattgcaagtcaagtattgatgtatcctactgttatggtattgctgtatgtttatcccttcaaatctgtcaatgattgctttatgtatttacatgctttgatgatggattcacatatatttataattgttatatcttcttgatgaattaactcttttatcttatttaatgacctactttgtctcttgtgacagttttttttttttttttttttttacctaatgtctattttggctgatataattatagtcagtcctctgtgtctgtgggttttacatcatagattcagtcaatgctgattgaaaacactgtattcatggaatgtgaaatccagatacagagggtcaattttttttatccacaggtcctgcagggctaactgtgggacttaagcatcctcaattttggtatcccttggggttccagaaccatgaccctgtagatactaaaggacaactgtatagccccattactctcttttggttaccgtttgtacagaatgtatcttttttgactgggcacggtggctcatacctgtaatcctagcactttgggaggccaaggcaggtggatcacaaggtcaggagatcgagaccatcctggctaacatggtgaaaccctgtctctactaaaaacacacacacaaaaaattagccaggcgtggtcgtgggcgcctgttgtcccagctactcgggaggctgacgcaggagaatggtgtgaacctgggaggcagagcttgcagtgagctgagatcgcaccactgtactccagactgggtgacagagtgagactctgtctcaaaaaaaaaagaaagaaaagaaaaagaaaaacagaatttatcttttttatcaattaactttcaaactatgttttcttaaatttgaaatgagtatctggaaacagcatataacgatcttgttttcataaatctatgcaggcattgtaggtcttttcattgggaagtttaatccatttgtatttgaaataatcattggtaggtaaggacttactattgcctttttgttgaatttttctgttttgtaattcttttttctgtctttttctctcttgactgtcttcttttgtgattggttgatattttactgtgatatgctatgatttctgatttctcttttttatttctgtatttttacatggattttccatgaggcaatcacaaatataatagtctactttaagctgataacttaacttaaatcatgtaccaaaaatctttacttttaatacctccctcacactttttgttataaatgtcacaatttacatctttttataatgtgtttctacaaacatatttttgtaattttaattattcttattttgacatataacttttatattagaattataaatgatttacataatactatttagaaaaaataatagcctgacttacagaatatcttccacctaggttttaaaggggtgcattttgcacaaggcctatataagctatagggaaacaaaacacccacacaagtttctctattgaggtaattcataatcttctattagttttatcccactcttcatcatattgacaaccagggtatcattaggggaaaacaaaatctattactttgattttctcctctaagttagagttttctcctctgcagaagtttttctgcagcttcttctgttaagttcttggcaagctgtaatattcagtccccattaatgaacaataaaggatctgggcttctcttgacattgacatgaagtctctctctctcatgcctttccagtaggtgagatgaatatgaaaattacataaagactgcatattaaatagaggaaagctgagttaaaacagtctaaggtggctgaatatggtggctcatgcctgtaatcccagcactttgggaggcaaaggcaggcagatcacttgaggccaggagttggaaaccagaccagccaacatggcgaaactctatctctactaaaaatacaaaaattagcctggtgtggtggcatgcacctgtaatcccagctacttgggaggctgagacatgagaatcacttgaacccaggaggtggaggttgcagtgggccaagatggtggcactgcactccagcctgtgcctcagagcaagactccatcaaaaacagcagcaacaacaaaaacactctaaggcagaaagggaagtctggttaacattaggtatttgatgaataagaaaattcagtataataggaagcttcccattcaatagcaaaccgaaataaataaataaataaataaataaataaataaataaataaataagagaaagctgaatattaccaaatccaagagaataaagggaaaccataaccagatcatctttaactccagtaccctgcaagttaagtaatgatctcagaactagaaatccttgaaaataaattcttaattatatggattatactaatttatgctgtgactaaaaaagatgtaattacagatcaatgtagaatatacataaatctgtaaaacttacagataatttaagaaattagcagagaatgaagggagcaactgaagcttctagccctctttgtgagatttaggcttttccagtcaaaaacctcatttagatgttatgttattttgtgttgattttaaaagttatattttcttttacataattaattggaaagtccttcagtttgggtctgataattgataacttcctcagtacccagaaatctatcaagcataatgttgacatccaataaagtgtttatgttgaaatcctttatttagaattaaaaaggtagtcaaagagtttcttgaaacagagatatagaaatgtatattatctttttagtttatattcatttttctgtaaaggaataatggcatattaaaatgaatataaaattaatacaattttggttattgtatgtagcccctattcttttttgttgttatactttaagttctagggtccatgtgcacaatgtgcaggtttgttacatacgtatacgtgtaccatgttggtttgctgcacccatcaacttgtcatttacattaggtatttctcctaacgcaatccctcccacagatcccaaccccccagcaggccccggtgtgtgatattccccttcctgtgtccttgtgttctcattgttcaactcccacttatgagtgagaacatgcagagtttgattttccgtccttgtgatattttgctgagaatgttggtttccagcttcattcatgtccctgcaaaggacatgaactcatcattttttatggctgcatagtattccatggtgtatatatgccacattttctttatccagtctattattgatggacatttgggttggttccaagtctttgctattgtgtatagtgctgcaataaacataagtgtgtgtgtgtctttatagtagcatgatttataatcctttgggtatatatccagtaatgagattgctgggtcaaatagtattactaattctagatctttgagggatcgccacactgtcttccacaatgattgaactaatttacactctcaccaacagtgtaaaagtgttcctatttctccacatcctctccagcatctgttgtttactgactttagtgatcgccattctaattggcgtgagatggtatctcattgtggttttgatttgtctttctctgacgaccagtgatgatgaacatttttttcataggtctgttggctgcataaatgccttcttttgagaagtgtctgttcatatcctttgcccactttttgatggagttgtttgtttgttttcttttcttgtaaatttgtttaagttctttgtggattctggatattagccctttgtcagatggatagattgcaaaaattttctcccattcagtaggttgcctgttcactctgatgacagtttcttttgctgtgtagaagctctttggtttaattagatcccatttgtctattttggcttttgttgtcattgcttttagtgttttactcatgaagtctttgcccacgcctatgtccctgaatggcattgcctagggtttcttctaaggtttttatggttttaggtcttacatttaagtccttaatccatcttgagttaatttttgtttaaggtgtaaggaagggatccagtttcaactttctacatatggctagccagttttcccagcaccatttattaaatagggaatcctatccccattcatcatttttgtcaggtttgtccaagatcagatggttgtagatgtgtggtgctatttctgaggtctctgttctgttccattggtctgtatatctgtgttggtaccgtaccatgctgatttggttactgtagctttttagcatagtttgaagtcaggtagtgtgatgcctccagcttggttatttttgtttgggattatcttggctatgcaggctctttgttggctccacatgaaatttaaagtagttttttccaattctgtgaagaaagtcaatgggagcttgatgaggatagcattgaatctataaattaccttgggcagtatggccattttcacgatattgatttttcctatccatgagcatggaatattcttccatttgtttgtgtcctcttttattttgttgagcagtagtttgtagttctccttgaagaggtccttcacatcccttgtaagctggattcctaggtattttattctctttgtagtaattgtgaatgggagttcactcatgatttggctccctattctttatcaaagttctgaatattagccaaatcatcaaagaggatattcattacctttaattcttataacttttcttagcaataaaattcatggtaagacagctagcagataaaaaatgtacaagtacatagtttaaaacaacactgattagcacaccaaaagaaaattgagccaatccttgttatatgtaatacaaatattttatatatgtacatttagctgtgtttggagacccacgtttctacacatatataattatttaagacatagtttatgtatagctaccatgaacacaataaaatacattttatttctatattaacacattttaacctatcttagtgatctgtagaaagatctagacaatgattctggttttaactacatttcttttttgtttctttaccttggaggtcaagacatctttatgacagaagaacagaagaaatactacaatgcaatgaaaaagctggggtccaagaagccacaaaagccaattcctcgtccaggggtaaaaaaaaatatgtatctttagcatatagattttcaaattatttctaattcatttttaatgcacatctttaatttctagatactacttgaaaaatttactctgcattcaatattattctcgtttctttgcagaacaaaatccaaggatgtatatttgacctagtgacaaatcaagcatttgatatcagtatcatggttcttatctgtctcaacatggtaaccatgatggtagaaaaggagggtcaaagtccatatatgactgacgttttatattggataaatgtggtttttataatccttttcactggagaatgtgtgctaaaactgatctccctcagatactactacttcactataggatggaatatttttgattttgtggttgtgattatctccattgtaggtaagaatatttattattcagattttattttttgagtaaagctacacttcacttatgctcgaggaagtatattctgaattcttgaatgcagatttattcttgagtaagtcagtataatgaaagaatgaaaaaatcctaaaaagcaaaataaaaatatctgtgtctctcatactacagtgtttctgggtttacgctacaggccccaaagccaaatatttctatctgttagaaggaaattatacttgttgatatttagtttccaatattacctttgcaaagctagttaccatgtttatatatagctgtgtatatagctgtgtcttggaaaaaccagtgttgaatctgaaatcacttctggttttagcacatgtgagacttgtcatttgattaatgataatatcaatagccagaatatctgtgaatttctgaaaattcttccagaatttaaagtgaagttaaagtctctagaaatgccagttttattttttaaggcttaatacttcacaagtgtataaaatgcgaatcattcctcaaccagccatggtcatgtctgtgaataacagcacatgattttatacttcctacatattcattatcatggctgtttttctatcttcttggggtttttttcattattttcacatatcttgcaaagtattttaggattgtatttctttttagaattataaacttttaatagagattatagagattatttactacaaacttaatcaacaggttatcagtctgaaaaggttaaaggttgcataacttagactcataaaactgagtgccacagaacagaataagcatttaaaatcaatatttttggaaaaggatattatcaccagaagtcataccaaaattgatataggaaaatcaattaaaatttagatgagaatttcacactaacaataataattctgaaagcattcccattaagtcagggaaaaaaaggtgtccctgtatcatccctgtttttaatagtgttggccaatgcaattagataagaaaacaaagaggtacatatatccaaacaatggagcaaacgatccttatcttaatataatgaccttcttcatataatgaaagaagttcttcatataatgaatgaccttcttcatataatgagagaatcaactaaaaataaattcaattagagttgaaaaggtacaaattttaaattacatgtgccaacactaataatcttatacatgaaaaaaatagaaaatctgattcacaattgcaataaaaataaagtaaattatctaacaataactttatcatatgagacttctgaagaaaactttaggatataaaagaaagctgaaataattgaaaggattatcatgtacttagataagcttctatcattgtaattaagacttttttatttattaatctacaagttcaaggaaaatatcaatgagtctttttatgcagtgggggtaataaattgacaataacaatgtaagtctaaatgattctaaattcatcggaagaaaattagggtgataagaggtggcttattctgcaaaatattaagacttataatattgatgttaagtaaaactgttcaaatacaaaagctcaatgagtttgaagagagagtccaaattaaactttaatgtataattaccaatttactgagtgaacggatcacatgaatcaaagtctatagttaaaaaaagagattctagtaggaaatatgtggaaatagacatataaccatatactcttatagtcctttctattcataacacaaatttgtaaagctaaaaaaaaaaacgaagaagaaatgactgcacaaaaaaacaaaatattctttgaggaaaaaatcatcataaataaaaggttgaaagacaaaaaataggggaaatgtttatgtaacagttaaggctgagaaaggatcaatactttaaatagaaaattgttcttataaattaataagaatatagtaaaaatcccaatagacacatgggaaaataccaactaagccaaaaacagaagttaaaaacaaccaataaggatacaaaatgacaaaatacaagacaaattgtggattattttcacaaaaaatgcaaataaattacaatagtagatgttttcaaatgtcatgaccattttttggtaaaaagttataaagaagaatggtagtactcaatactggtgaacgtgtaaggtatgagcacattcatatactgccattagaaatgttaattagtacaggctttctggagataggttcagctatatatagtgtatttatatatacacatacatactatatatagtatatattatgtatatatatagcatgtgtatatatatatggtatatgtgtatacatagtatgtgtgtatttatataactgtatatatgctgttgaaacaagttctgttaatatattattaaaacgtactcatgcaattaggagaacatacctatttagatattcatttcagtaacaaaaatggaaacagtataagtgctagtcttcaatctgtggttattttaagagagcattataccactataataagttattttgttgtcatttttatgaaactatctccatgacacataaataaattaaaataggttacaggctgggaaccatggctcatgcctataatcccagcacattgggaggccgaggtgggtgaaatcatttgaagtcagaagtttgagaccagcctggccaacatggtgaaacccgtccctaccaaaaatataaaaattaaccaggtgtggtggcgcatgcctgtagtcccagctactctggaggctgaggctggagaatcacttgatcttgggatgcggagattgcagtgagccaacatcacgccactgcactccaactttggtgatagagcgagaccctgtcttgaaaaataaataaaaaataggctacaaaaaaagcttatataacatgaatacatttgtttgtgtgtgtacatatgcttgcacagaaaaatgtctgaagtgatactcaaaaaaatattgataatagttattgttgttgacatttcaggtggtttatattttcttttagcatttaatggtattggttgaattttctatgtgagtaggtattattcttaaaatttaaaacactattatggaggaagaaaatggcccatgaacttagtaaaaaggagaaaatgtcagaatggtaatgtcagtcatttttctttggaattgcttaatccttttttaagtaattgcattcagtataaaataactgtcttgaattcataagaaacgagttgacagataaaactgtttagagtcatcattttatgtagcatagatatttagatattttatttctattattttcctccacacataggtatgtttctagctgatttgattgaaacatattttgtgtcccctaccctgttccgagtgatccgtcttgccaggattggccgaatcttacgtctagtcaaaggagcaaaggggatccgcacgctgctctttgctttgatgatgtcccttcctgcattgtttaacatcggcctcttgcttttcctggtcatgttcatctacgccatctttgggatgtccaactttgcctatgttaaaaaagaagatggaattaatgacatgttcaattttgagacctttggcaacagtatgatttgcctgttccaaattacaacctctgctggctgggatggattgctagcgcctattcttaacagtaagccacctgactgtgatccaaaaaaagttcatcctggaagttcagttgaaggagactgtggtaacccatctgttggaatattctactttgttagttatatcatcatttccttcctggttgtggtgaacatgtacattgcagtcatactggagaattttagtgttgccactgaagaaagtactgaacctctgagtgaggatgactttgagatgttctatgaagtttgggagaagtttgatccagatgcaactcagtttatagaatataacaagctctctgattttgcagctgccctggatcctcctcttctcatagcaaaacccaacaaagtccaactcattgccatggatctgcccatggtcagtggtgaccggatccattgtcttgacatcttatttgcttttacaaagcgtgttttgggtgagagtggggagatggattctcttcgttcacagatggaagaaaggttcatgtctgcaaatccttccaaagtttcctatgaacccatcacaaccacactgaaacggaaacaagaggatgtgtctgctactgtcattcaacgtgcttatagacgttaccgcttaaggcaaaatgtcaaaaatatatcaagtatatacataaaagatggagacagagatgatgatttactcaataaaaaagatatggcttttgataacgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaagaaagcaaaaaatagaacttcatttttgatatattgtttacagcctgtgaaagtgatttatttgtgttaataaaactcttttgaggaggtctatgccaaaatcctttttatcaaaatattctcaaaggcagtgcagtcactaaccctgatttcctaagaaaggtgggcagcattagcagatggttatttttgcactgatgattctgtaagaatcgtaagagaactctgtaggaattgttgattatagtaaacaaaggtgattcagttttttggttttcaataaatcagaagaccacatagaaaacttttacatctgccttgtcatcttttcacaggattgtaattattcatatttcccatgtaaataaacaacacacacacacacagaaaaatctattatttatctattatttgaaaatcaacaaaagtattttgccttggctttgcaatgagatgcttgatagaagtaatgaacattagtaatgaatgtttagttaaaatgcattattagggagcttgactttttagcaatgtacagaggttattctatatattgaggtgcttaaatttattctacattgcattagaaccaatttatatgtgcctataaaatgccatgggattaaaaatatatgtaggctattcgtttctacaaatgcttttcattcatcttgactcacaagccaacaaggataatacttacctttagagtattgtgtttcatagccttctttcatatccctctttgttcatagaataaccacagaacttgaaaaattattctaagtacatattacactcctcaaaaaataaagataactgagaaaaaaagtaattgacggaagttctatttgctattacttatatagcctaacattgggctgtgctgcccaaaatactgataatagtctcttaaacttttgtcaaattttcctgctttctcatgcggtattgtttagtcatcctttagctgtaagcaaagttgatgaaatccttcctgatatgcagttagttgtttgatcatggtatatgtttgagcagataataaccttggcacagtatttattgcatcacttgtatacaatcctgtgtttggcaagctttcaagtcatataatatgacagactttcaacacagatatatgtgtttagtatgaataaaaaagcattgaaatagggattctttccaactcgctctcttgccaccaacttactttcctaaattatggaagtaatcttttggacctacatacttcaatgtatacaatgaggaagatgtcaccttctccttaaaattctattatatgaaatatattttgcctcaatcaacacagtaccatgggcttctaatttatcaagcacatattcattttgcattagctgtatacatctagttttttgaaaacacctattaatagtactttgaaaagaaataactgtaatgctttttttcatgagtttatttcaggaatatgagatctttcttctataaagtcattcatgcacaggcaaaagttgagctacatagatagaacatagttttatttagaagatttttgtgggaggttttgaagcgaatatataaaacatctttcactaatttgcttttcatatttaaaaaataataaattacatttatataataaatgtttaaagtacatatttttgttgttctgaaaattgaaaaagaaaggatttaaatgtacttatagaaacaaacggttatggttaaagaatgagacaggaagtctagaatgtttttaaattgtgatatattttacaacatccgttatgactttgagacatttgttctaatgtacgtataaaactatatctagggctaaagattttttataccatcttaggttcattcatcttaggttatttgaaccactttttaatttaatatgaaagacagcatgcagtgttttccgagactatatagatcattgcatcccatacctgccacgcctgttggaaataggttttgataatttaagtagggacctacaaaaaatatattacagtcatcaaattttttaatacattcaattaagaatttaacatcaccttaaatttgaattcaatctatcattatttcaaactcacaagttaactgcattatgaatacttatataatatagtatgaaaagatgtttgacaggtttgtgtgtaattttctattaatgtttttacattgccttgtttttatgtaaaataaaaaatatgggcaactggttcgttaacacaatttcttcttagcttttcaaaaaaacatataaagttgttctttttcctatttcatgaactatgattttttaaaaaataacatggttaagttttatatatatttatgtttgtttcagaaatgtctacttgtgactttttatcaattaaaaacaatatttggaagaaagagcctattaagtataaccttgaagtaaaattagacttctctttccgtgtggattactgtttgtactgattgtatcacccttcagaaggcactgtcatattaatatttaaattttataatcactgaacttattacacccaacaatacagaatggcagttacactgaagaatttaatttagaataaaatggaagcaaacaggttttctaaaaattttttttaactgaccaggtcttgctctgtcacccaggctagagtgcagtggcatgatcatagctctctgcagcctcaactctgggctcaagcaaccctcttgcctcagcctcccaagtagctaggactacaggtgcatgccaccatgccagctaatatttaaatttttgtagataaggggtcttgctctgttgccccaggctagtctcaaactcctggcttcaagtggtcctacagccatgacctgccaacatgctggattacaggcatgagccaccatgccccagacaggtttgaacacaaatctttcgaatgaaaattagagaatctaattttagcattttgatagttacctagtttgcaaaagatttgggtgacttgtgagctgtttttaaatgctgattgttgaacatcacaaatatttagcatgattttatagaattttgatagctttatttaaaagagtgaaaatacaatgcatacataaataaagcagttctaaatagctatttcagagaaatgttaatagaagcactgagagaagggccaactaaattaggatggccagggaattggcctgggtgtaggacctatgtataaaggccaccagtttttaaaaaatatctgtggtttattatgttattatcttcctgaggaaaacaatcaagaattgcttcatgaaaataaataaatagccatgaatataataaagctgtttacataggattctttacaaattttatagatctatgaatgctcaaaatgtttgagtttgtcataaattatattgtagttatacttgagaccgacacattgtaatataatctaagaataaaagttatgc

SEQ ID NO: 3 - DNA, 167294 bp, sus scrofa
ggggaaagggcggggagcagggaggggtcgaagaaccggggcggggctgccgcttccccgggcgcgccccggaaggaggggcgcagtctcctggccagttctctgccgcgctcccgcggctggtgtccggtgtccaattccgagggctcgactggctggggctgggctagcttgtgtgcccgcggcgggtagtggcaggcattctctgagcaacaggagcccagagaaagagggagcatcacttgcagcggagagaacgccaggggaaggaggccgggagcaagtaagggcccctgaagcctgcgccctccctggggcgagaccctgtgggcactctggatggacgtggtccgcggcaaggtagcaagtaagtgccttttcgtctggtgtggcggggagggaagccgtcggtctcttgcctttgctcgcctcaatcgccacacccacctgtgtccgttttcacagctctcagttttagcccctgggtgttacgccacctggaaagtagagaggggagaagctaggcgaggaggtgccggcgattggacaaagaggagctggaaaggcagctgttttccttgcaaggccggtcttttgctagttttgacggtgtgggtttgctggtaggttctgaaaatgtggaaaggcaaggcagctgtacctaatggtttactattatttctttcgtctagcagactagcaaagtcgttggatgggtttcggttccagggccaggtcgtattctttagaagcaaaaagcatgggttatatttcccatctgcaaaggtgagcgtgcagaaccagcagagctgaagctacctgtggggatggcgaggatgcgccgcacccgtgcagaagcacataaacacgagcaattggccggaccgcttagccccttttctccatgaagtttattattttttttcaaaggagtaagcattttatagtgaaattcagataagatttagaatcattttaacttttcatggacttcaactgaaactgtcattccatttagaaaaaaaacttgttttcattacttattttcaagacaaaagattaaagcaagattaacaaactggaaacttcagtgccaacttttgtgataatagcaaacatatttcttatttcaatatttctattagttgcagctttcggagtaatttatatctcttttgaagctaagagcaatttttgagtgagagaagcttaggggagttttttaaaagccactgtcaataagataaagactaagtcaacacaggcttttaaaagaacgatggattttcagttgctgaatgtgaagtcaatattagaaggttgttttttttcagaaacacgattaatgttcttttctcttctgcttttgtatgggcggcagaaagatattgtctgtctttctcttggtaatataaaatattttcatgattttttgctttaatatcaataaaacctacctatatataatctgcaaacgaaatccaattattaaacagtccattttattgaaaagacttcaaattatttttcatcattttagaacctttaaactagaattcatgttttgagaaactatgttaagtaggatctttaacaaaattttattaattatttgaaggctagtctttttggagacctatgtatggaatgatcatgattgctagagtagcttattcacaacaaaatgcttgacaaaaatatggcatttgatataatggaagatgtgcccccattagcaactgacaggagttttgcttaagataagtttttgtattttgtagatgtttgaaatacctgtctattaaaggatcccttttaaaagtgaacaactgtgccattgtggacatagtgatatatttttataaaagccaggtatgtgatttgccatgattctttggtgcagggcagggcttccagagtacctgatgcttctacagaagaacgatgagtcaggtctggctgcctgccaaaagcatcctcctgccttgtgtctccgaagaccaggagataatcttgggagccctcctgtggtaatgtttctgtgtttttgctacctgttgctgaggtgacttcaggcagcaaagaaaaagtaagaagtcagaagtggaatcactggggtcctattcaccttatttaatgtgacccaactttctttgtgacaaagaaaaaagtagaatcttgcatttttcatgcttagtaaaaactaatattgatctaatatctattcctatcagatgtgtgaaagagggtgaaatgcaaggaggaattgtacggtatttttctaactgtgtaaaagaacttagcatttactaatatgaatggatggatcataatagtatgaatttatgattttccttaaaactctaccttagatccttttccccagtcttcttcatctgaagtagtggttacaccatgcaccaagtgttgattgctttctcttcctcatcgtggcatttcatccctaaccagtccatatttagattccgtaacaatctccattcaattataattttcagatgtacctcttcccaccctgttttcagtgactttgtgctaccaaattaccggcatcatcataatcttcctgcattcctactacagccttcacattagcctctctacgtccatagtttgctcccttgtaattcactctatacaaagcaatgctatcaggcctcttaaaaaacattcattagctcataactacataggaaaggggaataaatgtggaaacacagaaagggattaacgacaaattccttctgttattatgtacttctctctctgatctagccctcctctgtgacctccttgggtacatctcccactcatttacatgcaccagcctccctggcatttcagtacctggaactcttagagcaatttcactccctaaggcatcttcaggtgttctcagctcctggactatttcttcctgtcttgtttttgttttgttttgttttttcatttttttaaggttttattaagtatagttgatttacaaggttgtgatcatttctgctgtaaaacagagcgattcagtcatacatgtgcatacctccattccttttcaaattcttttcccatatagattataacagcatattggatagagttctctgtgttacacagcaggtcgcttttggccagtcgttccatataccagtgtgcttatgccaatcccaaacctccatccatccttcctgtctttaaatgcctaactcctacacaaactaagtctcagctcaaaggtctcttcctcacagaaatcattcttgatcaccttgtcaaaagtagtctgttacctgttggtatctgtcttggtaccttgttttttccctccatggtgcttattatatagcacatgggtatttgggggatttgtgtattgaatgatccaaatgaatggatactatgtgtttattttttaccccacttccagaacagtgctgcagtgaactaatagagggttcctagatatttatgcaaataataaactacaaggataagacttacttcaccctagagcccactcactctgtaaatctatgcattttagagctcaattttgtttttattttttgagcatctggtatgtttatgacactgtcttatgactttgaggaggcaaaattaaaatatcctgagatgtatttccatctttcagcagtgtaggcattaaggtgttcaaagggaagtagattatattacatatttttagaaaggcagtgatcacaactggattaaaatatatttgaaagaaaacagtagagtgcgtaagcctattggcttattggatttttgtgtgagtgactcctaaaatacagtgatgactttatgagatttaaatctgtatcttttaccaaaatttgaaggtcacgcagtaatcactaaatttaaaatatagttttgtaataaatatggacatttgagtgagctccattgatggagtgtggtcaaacaaggctgagtccattgggtacccacgtgatctaaattgatgtttacaccaaacttaatttcataagttcaaagtgttcactgaagaagactaagagagacactgtgggaaaatccaggaggatccgtcattgttattgggacaggggagtggggcccaaaattcacactggttaatgacagcatcatatttatactagaatttatacacatgttggtacacacacatatgcatactatttgtgtggtagtaagttcccctccccttttctgagactgtacttaaagataggaaacaaataggtttcctgttaacatttgtttgaaaaattagctttcaattagccaacaagccttgattaatgatattttttatcttgcaagtggtcaatcatattttgtttgttctttctttgtttttggtaaagaatttgataatcagttttctttttgaagaactaaactatttcatgaattttcaccagggattttgctaaatttgcaatttcagtggcacagtgtggttgttgtaatgtattagagtgcctctgtgcactgattgaagatgggcctccatcttacacatcccaaattagttaattcatccttacaaggaggtattatagcttccttcagaaccatatagaattagattgccatttaagatggcaaggtcataatgaaatggacatttaagattgtataaaaatgatcttcatatgagggtttataggcgagcattcacagaatgtgggtagattacttttgtggaacaggagagaatatttggtgtcttgccatcctagaaaatgaaatttcttcattgaaggtgtaatttacccttccttctctgtgtagctggaaggaagtggctttagacaacagggagatccatcagctcttggcagctaaaggtagaatgaagtttggaggagtaaaacccttgagtggtgaggaaaaatgccagaccatgaaaaacgggaaggaagagggaatgccttgaatagcgccaataaacatcatctgccacaaacaaatttgagttgacattatgtatagaattgaattatcctatatctttttagccccactaaggaaataattttctctttaaaaagaacaactgcatcttgaatgaaaaaatgctgtcattgcttctttaatacaggaaatggaatacctttggattttatctctatctatctatatatctatttattttattttttagggccacacctgcagcatatggaggctcccaggctaggggttgaatcggagctgcagctgcctgcctacaccacagccacagcaacacagaatccagtctgcgtctgtgacctacaccacagctcacagaaacaccagatccttaaccccttaagcaaggccagggatcagacccctatcctcatgggtattagttgggttcgttaccactgagccacaaaaggaactccacctttggatttttaaactgatataaacaagagccaaaataccatatattagtgttgaaatataccattactttaattgtaatttcatttctatttgttttgacttccctttgttgtgtcagttgtttgagagactgccattattgatcacagctttctttaaaatgtttctttggatttcatacaaagctgtctgaatcatttatcaaagtatgataaaactttaattggacctatgattgttcacttggaagttctttgctcttagaggaccttagtacatttacaatatcattaacctaccatctctaccctgcaattaatgccttttttctttccttttctctcctccatctcatctctaaacttttgatctatataccagtaatacaaattttgctgcactattaagtcaagtattaatacaataattggaaaattgagcctctaaattagaattaatataattagacagatgcgttaaaatataagtacgggagttcctgtcgtggctaagtggaaatgaatctgactagcatccatgaagatgcacatttaatccctggcttagctcagtgggttacgtacagatccagcattgccgtgagatgtggtgtaggttgcagatgcggcttggatctggtgttgctatggctgtggcataggccagcagctataactccaattagacccttcccctgggaacctccatatgccatgggtgtggcccttaaaaagacaaataaataattaattaaaaataaaataataaaaataaaataacataagtgtgaagtcccttagtacaaagtaaattataaagtacaaagacatttttggagaaatgttcaatgaaatcctgtttgtcttatatgccaaactaaactccctgtgtcatctaattgtttttaaaaaatagagatgatttcactagatgtagcatctgcccactgtactggttgctcattaactgtatatcttagaatcaaatgtaattaaaaatacattatattcttgggagtctaatttagcagtccaaaaaagaagtaaatatagatattcaagtccattcataaaaataaaactgaggaaaatgagagaaatgttatatgaaaaagaaatattcccttgtgtattgggattatttagtgatttaaaatggttattctttcaagttcaaagaacagcacttcctttagtacttaaggataatttactatatgtacattttaaataggataaatagaatattttattcataaattatgctttcactttctctggatgacgatatagacttaacattcattccttctaggtaagttttttttttttttaatgggaccaatctatagatgatcctttcatggaacaaatatgacaaagttaaagtgatgatttttcccccatcaacataatagacgtatattcttattaccctcgacaaacttggctcatggcaattcaagtaggaagaaaagaaattgcatcctcagggctcaatagtcccgtgagaccatctgatagagttttaggaatgaatacttgtggaatggccatacagagaagcgtttttgaaaattcatattatatctctcctatagctcagaatctttataaaatattgttatgacatgttaaaagcacagaggaataaatttgtgtttacattagtgaaaaaattgtttttctagatatttctcttgctgtacatgtaatctcagtctaattctttcacttctcaatagtgtctactcctcaaattactgtacaaattaggttaatatatatgtatactcaccacagccattttagtgccgtacacatggtaaggaggtgttcaatgatgctggctagtcacaatgtactctgattatattttgaatacaaattgtatagcatctaaaatttatcagtgttacttctacttttaatcttatttcagtgaatattaataatgcagtttcccctcactgtttttaaagacagtgtaattatatgtctctaatataggatcattccattttgaactctttataacactgttggtaaagtttttagctagaggctattacaaatggtttatatgaagtatctaaaaatttatcggtaggaaaacatgggcgaggcattcaaagatcaagaatttaaccatccagagttcctgttgtggcttagcgggttaaaaaacagattggtatccatgaggatgtggttccacccctggcctcgctcagtggcttaaggatccggagttactgaaagctgcagtgcaggttgcagatacagctcagatctggtattgccatggctgtggcataggctggcagctacagctcccatttgtccctagcccaggaacttgcatgtgccacaggtgcggtcataaaaaaaaaataataataataatttaaccatccaattatattttcttttctatatgtttttgaacctgatctgtcagaattctacattaatagagagcagttcagtggaagtgacctgtcagatgtcctgttagttcattttacaccaactagtgtctactttgataggatttttttaaagagcatgtcatgaaatttctcacttatgtgtgaaatcaaacttactgtagtaattcaattatcaggaatataactgaatttttaaatcagcaaataaaatgtctgaatctgagggagatacttgcaaatatattcattcaccttatctcattggtgatacattaacaaaaatcaaattcttgtaaagcaaatgtcaaattaagggtaataattaattttttatttattgttttctttactaattcacagtttttgctcagatagaaagtattacaataataagaggtgggcctcttattgttttccatctgaagacagaaaatgaatgtataagaggggagttcccgttgtggcccagcagaaatgaaactgattaataaccctgaggttgtaggttcaatccttggcctcactcagtgggttaaggatctggcattgctgtgagctgtggtataggtcgcagatgtgatttggatcccacattgctgtggctgtggtgtaggctggcagctgtaactctgatttgacccccaacctgagaacctccatataccccaggtgtggccctaaaaagcaaatatatgtgtagtaacatacatagtaatatatatagttttagttatatgaggtgcactgccatagggaaaatataaacagcacagcttacctctccttaatactactaataataacattaatttagcagcttcatatgtggaagtctcatttatgctgagcagtacattaagagatttgcaaatcctccttttaaaaccccacagccatcctctgaggtgagaaaacactaaggctcagaagctacctaatcttcccaaagactcacagtgattactaagtatataagtaaacatatatgttctttttaatggaaatagaatattatttattcttgcatatatcccacacagatatacctggttaccatgtattctacagaagacttttgaacccataatgaagctgaaatgatctagattggcaattaaacatagcaaactatgtaattaccatactagagaacaagaaaaagaaaggctgggagttcccattgtagctcagtggttaacgaatctgactaggaaccatgaggttgcgggttccatctctggccttgctctgtaggttaaggatctggcgttgccgtgagctgtggtatatgtcacagatgcatctcagatctggcattgttgtggctgtggtgtaggccagtggctacagctctgattagacccctagcctgggaacctccatatgctgcgggtgtgaccctagaaaaagaccaaaaaaaaaaaaaaaaaaaaaaaaaaaaggcccatgattgtttacatgttcatcttgaatactgattttggggtagtgcatttgtattaaactgaaattgacatttagggaggagttttaagacattatattataaaatatatctgtacatttaaattgtttctgaggttgtttcagatattgaataactttgctttcctggtctaggggtgtcactgtattactctgacttgaccacagacagttttgtttgttttattataagagaatccaagacaggaaagggaactttcccaaggcagacaagagttgaaagaagagtagtgacattagggtgtgcatgtgtgaaatatctgggatagtttcattcaactatgagctgtgaaatggagtggagttggacctatgagatcccgggtgttaggggatggaggagataaagcaaaagaccttgtgcagggtaaggaaagaataagacagagtacatctaaagtattcttatgatctaacctaaagcttagtcctgattgtcacaaagaatcaataatttatgttcgttacaatgattctttttttttccagtttttttttttttttaatcttttttctagagccgcacccacagcatatggaggttcccagactagggtccaatcggaactacagctgctagtagctgtagtctacaccagagccatagcaacatgggatctgagccacgtctgcaacctacaccacacacagctcagatccttaaccgactgagcgaggccagggatcaaatccacaacctcatgtttccaagtcagatttgttaaccactgagccacgatgggaactccaagtgattctttaatatcagtgattcagggtgcttcctcttaagggttttaaaacatttggggaaaataatttattttacataatacttataataattttctagtgcaaatggttttcttttaataatatattatctacttatatcccactgtccttcaagtgggatataaaaacatgagaaattggactcctgagttctatgatctgtctcaatctgttctgatgactgtggattggcaacttatccactaggctgttaaggttttaagagtgaagcccataacttgttcttgttggcatctatgataaagttattcttaatacatatttcacaaataaatggtgcatgtttcttgcacaactatttgctccttttttactaaaaatagctcttttcactgaaacttacatttctaagaatgtaggaggaataagttaacaatgatttagtaatttatgattctcaagcctttattattactaggccctaatgaaacaaagtcatgtttctcatttcttactcaggaaaggaacagcatttttgcttattttctgccaattctagatgacaatatttagccttctttgcataaaagagccaaaatattttgacatgtcctcaagttgatgcattaaaatggctaagcccaaatccttttctaaaagcgagagttatcctttggagaatttgtttaacaggtggactgctaattagatagtttaaaaaaacatttgaactaaaatttccaactgatttgtcttcagctgatgatcaattattaagccctatctggttggcttccaaaatgtgtaagtcaggcattcatatccaacttggtatcagtgccattgaggtttgtggggagggaggacctggcagaggtcccgagggtaatggtaaagcaatgctgagttgctctaggtcagttcctagaactctgagcatcaccattcttggaatgtctatgtttcctgaaatttcacggcaattccttctttcctcccctctacctttattcactcccctcagcaagtatttattgagtagcttgctcaagaccctgctgtagacactgtatgtatagcattgaacaaaacatggaggtttcctgctagttttgagacagataataaataaacaaatgttcacttcctaaccttgtattataatatatgctgtgaggaaaaataaatcaggacaaagaaaattgagggaaggaggcattatttaagaaggatagttagaaaagctttttatttttatttatttatttattttttgtctttttttttttttttttttcccttttctagggccgcttcccgcggcatatggagcttcccaggctaggagttgaatcagagctgtagccaccggcctaggccagagccacagcaatgccggatctgagccgcatctgtgaactacaccacaggtcatagcaacgcgggatccttaacccactgagcaaggccagggatccaacccacaacctcgtgggtcctagtctaattagttaatcactgtgctacgacgggaactccagaaaagctttttagagacactgtttgggcagagacctgaagggggtgaagaactgaggagccagctaagcgacaggaaaattatgccagtcgcaagaagcagcaattgcaatagccttatggcatagttgatgtgtttacagagcagcagagaagtcagtgtgactgatatacagagagcaagttgaaaagtggtagaagataacaggcttgacttgatatggaaaagactactaagtctgcctagaagtctgtgtgatgagccaacgttgtagtggctggcaagggacaaacattgggaggggatgaaatgtgctatttcaaaagaactagatctcattctggacataggtaaggacacaatccaaataaatgattgagaaactcttcatttccatacaaaattaattttttagttatttgtgatttatatgtaagtgttttatagcctcttcccatccgtaatagattagcttcttggaagccaattgagggtaaaagggttaatatgacagaggttaccactgagagtatctttaaatatttaaattctgggaattaaaacatggtgagagtacagtcatattttgtagattatgattaatttttatatctgttacataattatttctcatgaaataatgcatagatatagagaagtactatgatttgtggcagaatagatgccagggaaacacctatgaatcccatcaagtttgactcactgtgaactgctatgactttggtctcctactgacccgcttccttacagttttcaggaaatttttgtgaattaaaacataaattttggagttcccatcgtggctcagcaattaatgaatctgactagcatccatgaggatgcaggttcgatccctggcctcgctcagtgggttaaggatccagtgttgctgtgagctgcggtgtagactggcagctgcagctctgatttgacccctagcctggaaacttccatatgctgtgggtgcagccctaaaaagcaaaaaattaattaattaattaattaatgaaacataaatttttatggcaaaatagacataaaatttcccatttcagccattgttaagtgtacaattcaggggcgttaagtacattcacattgttgtacaaccattactactatcatccatccccagaacttttccatcattccacactgaaactctgtgcccactagataataattcctcattctttcctttatcccaagtcccttgcaaccactattctactttctttcttaatttgactaccctaggtacctcatataagtagaagtatacaatattggtctttttgtctggtttatttcatctagcatggtatttttaaggttcattgatgttgtagcatgaatcagaatttccttcctctttaggtctgtacagtactctgctgtgtgtacatatgtgtgtgcatatgtatgtgacattttatccgattcctccactgatggatgtctagattggtttttacattttgactattatgaataatgctatgatgagcattataaattgtgattgatgtataaatattttcttgaatctctgcttttaattcttttgggtatataagtggaatttctggatcataatataattctatatttgtttttaaaattctatatttaattcttttgccatactcctttctatggtgtctgtactattttatatttctaccagcaatgcacgagagttccagtttcaccacaccttcactaatatttattttctctctttttaaataatagtcagtatactgggtgtgaggttggatcttatggtggttttgatttgcatttatctaatgattagtaaagttgaatattttttcatgtgcatattgaccatttgtatattttcttcaaagaaatgtctgagtcctttgttcattttagaatagaggtgtttgtttttactgttgagtttaggagtcctttatatattgtggatatttaaatctcttaagtatatgatttgcaaatattttgttctctgggttgtctttttactttctgataatgtcctttgataaacaaaagttttaatatttatgaaatccaatttatcttttcttttgttgcttgtaattttggtgccgttattgaagaaatcattaccaaatcccatgtcctaaaagttttcttctgtgttttctttttatagtttttgctcttatgtttagatctgtgatccatttttttttttttcaatttctatagacattatagggtctaaaagtctccagcttccctttacccattcactcccaaggccttgttttagttcagtattcctttctctgaacgtttacttttcctttcagtaaccccatgtgtttttttcttttttgcttttctgagattaaagtgcttgagttattgaaagagtatggtaacaacatagggggattcctggtgcagaaagaatattatatattcatatgctcttactctctgattggattcattcatccttttgaccagtcttactattggaaaatgtttggttttggtcccttcctatgtagtctaggaattctgattccttactaactagttaatagattcaggagttctttctttttctggtcctaggtattaaactatatgattaaacagagcaagaattctgtctggccatggttataaccccttccaagaataccacagtattttacacatagtgggttctcaataatacttgtgtaaataaacaaatgaataaatgaaaaaaaaagagactatctcgtttccttacgtgtttagtaaatcaatgacttctgctatttagaatcttaggttcattttaatcaaaagcaatcagaaggaaaatctcctttcccctttctttcccttaattcttagtgaagagacaaatatttcaatcaattttttagaagttattttaaaagagtttgctgcaaagaactgagatttgaagatcagagtttgtaccacagatatttttttttgcacaagacagtccctgagcagcaccttttcccttgcgtagctgccagcaatgaaaaatggtgattttttatagaaattcattgtgtataatttatattgtcatgaaaatatgacatatggacatcttttttatttataaacaattcaaaacattaattaaaacaagagttaaaagaagtaaaagcttgtaaagcacctttgctattgaatttgcttatacactcttttcacctaaacactcatctcagaatgcaaatcttctggtcagatatctactggaatataaacttgaggaaggataggaattattttctccacatttgttactctgcgatccctatctaatctggtattttctccactgttctaagcctgtttgcatctattataagtgtctgaaaatcttgtctaaaaatggcagaaagtgaaaaattctgagacatcggattcacccctttttataaacagtcttatattttatcttctgaatatcttttaaacaacaaccacctcaaaaacagggtacgttttaaacagtattagatgggtttcatcatactcccaggtttgaaggtcagggttactaaatggctttgccataatgataggctctagttccaagaggaataagagtagaagtataaagcacaggaagttcctctgctgatgaatatattagtttgatggacatatttgcaaaggacttgtttgtaaattcatgcgatttattccattgttctttaccacccctatgtggacttccactaaataagctgtttctttggaatcgtaacacctcctttccctactgttatgcattctgaaaaaatgtctccatcaaaaatcttctaggtagaagacaacttttcttgataatgaccacaaatattccaaagaacctcttagcatgtgtgctacttaactcacttgttctgatattgagttaggtggctttgagtctattgaaccattcctgatctgccaggtatatttcatcaacggctatcactatgcttggattttactttcttgaacaaatacctatagccttctcttgttttaacattgagttctggagcatccactactaatgaagagcagttctctgacccctactagaaatttctacctttttgttttttttaataatttttctctgtatcatgatggctactgcctagcatcagcatttttaacttattgcataatcctgttcagtcctaacgagccttttctactatcagatggttaatcttttatgcacttgtcagattccttattttcatacactttcaattattattttcactttgattttcataaaattccaatttttgcttattaaatatttcaaccctctcagtatatttgcatttagcaagcctgatgggtttaataattttcatcacctcttgaaagcggtacacacagtctgtgtacactccatggactaatgagccttaagtccagcagggactgaagactgtatgatgtacatctccatctgtttgtagaaagcagtgtcatttggttttacaatgatcatagttttgttttactctttaaaatatcctgaagaagaaaaatttctgtatgtgcaatgcaaagattttcaattctgaagtaactaaatttgttcttctttcttaagaactttaggtgcaaaataaattgataagaaagttgataaaaatcacttaaaatggtcagagttttttgtgcactgctgtgtagcactggaaactatgtctggtcacttatgatggagcatgataatgtgagaaaaaagaatgtatacatgtatgtgtaactgggtcaccatgctgtacagtagaaaattgacagaacactgtaagccagctataatggaaaaaaataaaaatcattataaagggactaaaaaaagtgttatcaggaaacatgctaaatgaagggttagaatgtattagataatcattttcagccttgttttaaaatgcagaagccaagctttacagaggttaattagcttacccaagcacacaagttaataaactgtagagatgggattataacccaggtctttcactctggacccacaaatttaaaaactatgaatattgctaatatttagcagatgcactgtgttgggcaagaaactctatattttacctaataacattgtaagacagatacttccatttatgatgagtttacgtaatgtcacaatgctacttatgtgttctaatcaggtaaatcaaacctaacccttcctggcaccagagctattatgcctttcttcctaaactgagttaatgttttttggggggagtggttacatgcataatcaaagagtggaaaagcactttctgtgtaacactttataaagagaggtataaaacctcttcttggaccacattttagtgaccctacaagttacctaagtttgtgacgatttatgctgtcagaaaacggttaattttgaccaatagagaaaatttaatgtgagcaaataagtctttccccttactccttcatacatcgcatataaatggggctgcatgacttttctttttttaaaaaaacatttattggagcgtagttgacttagtatcatgttaatttcaggtatacagcagtgaatctttttcagattctctttccatatagattattacagaatattgaatagagttctctgtgctatacaataggtacttgagttttctgttaaaatttcatatatgccagaaatcattgacaatagtcttaattttcctcaaagtaatacatttctttaaaaaattttattatagttgatttacaatgttctgtcaatttctgctgtacagcaaagtgacccagttatatctttatacattctttttctcatgctaccttctatcatgttctatcacaagtgattggatatagttccctgtgctatacagcaggatctcattacttatccattctaaatgtaatagttgaaagtaatacacttcttgaggttataaactttataatctcttataaatttgaggaatactatcttttgtaagcccatgcatagagacaatgtctatcttagagtataacattgataatcattactattataaaagacccagatcacaatattttaataattctcctcatcaggagtctagaaataaatccctgtctactgctattctttgtataaaaatatccttaaaaataaaattaaccttaaaaaattttatatataaaatgatatataaactgtaataaaaactctttgagtgattttgggacatggaatattgagtttctcttttgaagagtttgtcatcacccaagttaatatctaagaagtaataatcactttaataatttattagtatgattaacatggtattaaatatgaaggatgcaatggcaagatttcagcaattagaaaacaattaaaatgattgttaatttgttgatcattatatttgacttctagatgatgctcttaacattaagggctttaaagtgagtagctaccttcagcacatttttcttattatgacggtattctttgtatttgcgatctaaagagacgtggttaaggaaaggagttatagcatgtaaagagagcagttctttttaagttaacataagtttactgcaatcccagtgaaaataaaaataggattattatcttcaaaattagataacctgagtctacttaactaggacaatacacaaaagaaagagtaatatctaataggactaatcccattaaatagtaaatgattttataaaactagagtaattaaaatggtgtaatcttgctataatacacagtgaactagaagaaaatacgatatccagaaatagttatgagaattgtaaaggtggcatctcaaatagacgtaaggaaatattattagttaataggcatctttgggatacctttataaccatctggataaagataaatttagactgctaccttacagcttaatcccaaaatgcatttcaaataaatcaaatatttaaaatataatatataaaactgaaaataagtcttattagaagaacacatgttgaattttttttcaaaatcttggaaaatttgtctaaggtaatgtaatgtacaatagtcattagagaaaggattaacaaattcagtttaagaaaaggaatgtatatgtatgtatgactgagtcactttgctgtatagcaaaaattgacacaacattgtaaatcaaccatactttaataaaaaaaaaaaacctaaatgctttaaagagtaagcatcaccataaaccaaaagaaatgaaaaacagcaaactgataaaatatttatatcttattccacaaaagagttaattttaatattatattaagaattcctcaattaataataatagaatagcccataataaaaattgacaaagtctatacagagagagctcatggaaaaggaagcacaatttctaaggatgggaaaagatccctaatcttgctcataggagaaaatgcaaaataaagcaattggaagatgtcatttcccactactcaaaatagtaaagatgaaaacagttttataaaactctgtgttgaagttacatgcaaacaatttctgacatattgtggagagtatgaattgatagaacctctgtgaaaagtaatttggcaatattgcctttttccaaattaaaaatgtagatacaattatgacccagcaattttagtttcaggcattgtctcacaaatacaatcccatatcgtgaacttgtgtatgagaggataatcattgtagcttgggaaacaaactaaatgttctacaagggagaatggctaaataattttggcctatttatacaataggaaattatcacgctattggaaaaagaagtggtggctctagacatgctaacatagaagtatttccaggttgtaattttaaagtgacaattacaaaatgtaaggtcttttgtatatagagtagtatttgtgtgaaaggaaaatgaatagcaatatatgtgtttataaaaacatgtagatgtatacacaagggattggtaccagtagtttcctccagagtaggaatatggatgactgggaagcaagagagaattacttttcattatatataattttgagtttcacggcagtatttattcttcgaaaatatatataagaatgctgtttagaggagtaaatgtttcataaatttgtagtttgggcccaactcttcacttaaaagtgtcctattcttggagttgtcctattctaattgctctgaagcttgaggttataatcaaataatgtatcctcaaaaatacatctaggatgaatttaaatgaacgaatgatgcagtgaaagtgtttggcagatcatagtgtatatagaaatatataatattattattattattatttagaatagtcatatgaattaaagaaattttcctattcacaattccaaatgcagaaaaggttatacagaagatctgaagaagtgggtgatccaaacaccaagaaaagaggagaggcaaaggttgagttcagtgaatctggtagaaataaaatgagcatcctctcagcctcacacctgactccagagactgtatgaatagctcatttataggtgcctgcttaccagaaatctattttgaaaataaaactctgctctaacactaggagaaaatatatatgcttaaaaagtctgaatattttaattataaagtaactatatagtttttttaataacaattatgtaattctatttattttcaaaaaaccaggtttaccaaagacaaattttaaagatggcaaactgacaaaaaataagtaactagtaattttgtgaaaagggaccagtatccttagcataaaagactctttatcaaaggaggaaatgatgaaaaccccatagcaaaaggaatgagagaacaagcagatttattaaagaagaaacagaaatgttccatgaaatgcacatttaaaaattgtttttttctatcaaatttggaagcatttaaaaaaattaatatacttaatattgtttgggtatgggaaaatatatgcttatatattgctagtgggaacataaatttttatagcctttctggaaagcatttgaactgtatgtatgcattacataaaaagacaaagtaaattcttaaagtatcatcataacttttctctgaatagatttattttattttaatctttatgcttttcaatactttctaaattttctaccaatggaaaattgctatatttatattaactatattaataaccttaaattaggtatatgcacaactttctacaaaattttttgtgttggatttaacaataataaaatattttctgtataacccggtcttgttatttacctacaaattttaaataaactgcattgttaatggcagaatttattaggaattatcaacaagttggtattgtatctgcctaagtttctaaaacaaataagttagcactttgttagagatccaaacatttgtggatttgtccttaatcaaatacatgtttcagacaaagtatttgcaattttgggatgctgaagcactggtgaaatggaagaacccacctaaagaatttttaggcatgactatatcagtgcgactgtacgtgactagtataatttagacttgaggaattttaacgtttaattaggtgatgtctgccgtaatgctctccatttcatctattagatgaagcttttaacttcactgttttttgtttttttgttgtttttttagctgtttcgattaaacccaagcagatgtttttatttgggaatcactaaaatgagaaactgtaaaagcaaaaatttcatatttcttgcacacatcaggctacatgtaactttacgatttattttgtttctgaatgtgttttaatttttgaaatgaggaaaacaataaatgagtgcaataaattttaagtttctgatataaagtccgtgatgacagctattttattgtatttgaagatactttcaaagtattgaaaattcttaagtagtttcattaaatagtaattgaaatttgcttacaaatctgtgtgatgtatacattcccttaaaggcaaagtgcttgcttctccccatatttgggttggggtgtcttcattcatcaagagttcaacaggttcctgtgatgtctagatactgtgcagtacattggtggtaaaaagacgcctgagacaagtttcctatctgaggagcttagagtctagttgaagaagataggcaaggagactaatgaaaggaatgaaacattataagaaatatgatttaaaaaaatctacactagagggtagttgggagcccaagtcagataggagaaatgagagaaggagaagctgataaaaagttgaatttgtattgacagaagaaaggtaggagatgaggtaagacttcatgagatcatataagagatgctgagctgaatattaagagataaataaccagatgatcagtttagttgaaacagtttggatacggggagcagcatgagaagtcagaggtcataaaataatctggctgctctttgaggaaatgaagtgtagagtgatgtaactagaatgcagactgcacatagggggagaaaagaggctgttaggaaaagctttctatgtcagaccactgacatggcaggttatcttgtaggcaatctttagatgtcgcagatattttttagcaggacaaggtcattgaatttccattataaagtcaggatctcttatatgttgaatggatattataactgatccagaattccttgatattactcaattaaatgctatctagcattttctatctataagacaactctttaaaaaaaaaaatctttttgtgctccataagaaaaacagagaaaacagaaagatcagagtccttaaaagttttaaattttgatttggagaaaacaattaattgttctaacaacccttggtattcctaaattgaaaaccaccaatatgatccatctcacttgcacaggaatacactcaattttcaattgatggaggcagcagaatagactagttcggacacctggggacccctctcggatggaaggctcagattcctatacttcgtgtggaatctctttccttttttaaagtatgacagtctcaatatttctttataattttggaggcaaaagtatcttgataatataatattattgtaactaaagagaaagaggtaacacatttaaaatagaatattttaatgaattcattaaaattctagtgaagatgcatttaataacagcaacatatacattttagttaatgattagtattttgtgattgaggatagctttcctaaatgcccctttactttcaggtaggatgtaaggctcttgctaaagcagtatctggtttctaagtttcagttttgctacattctgctgttctggtagggtttttttttttttttttaaattatcactatcattaatttgccatggtttttcattttttgaactttacttgtttttcaggtcttgttttatttactttatttcttgtcttagaacaaagggatgcatatgtcaaccgtgtaaatatttgttgagtaggacagtctttgaaagtacatcattaaatcagtatggatttatctagtttaaattttctactaagctatctaaagtatgactgtgttgtaaaaccggtatgtaggaaattccatgttagccatttttttccctctttataggtataaggtttattttctagtcatataagtataatttcaacattgtacatgttggttaagaacatgcagaagaaggaggatagtgtaaaagaatatttttggtatagtatatttcgtgtgtgtatgttcagatatatgtgtgtatatatgtgtgtgtatatatatatataaaactaattgtgtctcataacaataaaagcattataacacactccactggaataaaagattttttaggtgtcattgtattattttgcatataaacatgtacttaggtggtatcaggtatgctgatcatgtgcttcataataactgtttaaaactccagaatgagatttgtgcccattctaatgacagacaaggccttttgagaaaaacaaagacttgttctgtggtaattaaagataaccatatggggtgaaaaggtttggacatccagtgagtccgcatggtttttctacccaacccccaagcctaatgacttagacggtcttgttgtagtcgcttgtccatagcaaagacagatggatcagccagggagttcttcacgagctctgcctctctgaaaccacaaagtcaggaaatgtaatcagagtgctcagtcaaaccagagcaagagctttcctaatgggtaactgtgacttgagaaatcacatccattagataaagtgattaaatatacatcagacctttggcaagggagccatgaagatactgcagtagaacatcatcatgtgaccccgatctctcttgcttgaaaaaggaagcatgtttttacttttgacatgtgtatcatctcaaaattcctcagcccagctgtaaggaagacatttttttgagaagatttatgcagttctgattttctatgaactataaagtaattgtgtggttgataaggcattataaaagaaatatttctgacttgctcattctcccacactatttttgttttatattgttgttctctatgttttaggcatttcatacttcaagttatttaaaattcttccagtagaagcctttgtgttacaagataacattttttttcatttagatatacacatcttaaatatttaattagaaaaaaaattgttgtgcctgtgttcatgcagatttctcttagctttccaaagaagcttgttttgttaaaaaaatttttaaggaaaatttagctttataaagaaatattgccatcaaattgcattgaccttggctgtgtgtatagttctggagactcctgtttcttactctatgataaggatcctgtgattaataacacactacaatgatatattaatatacttgatactatcctacttgaggtaatgcatgctttttttttttttagggccgtacattggcacatggaagttcctaggttagggtcaaattagagctgcaactgccggcctacaccacagcctcagcagtgcagaatctgagcttcatctttgactcataccatagctcacagcaatgccggatccccaactcactaagccaggccagggatcaaaccttcgtcatcatggataccactgagccatggtgggaattccctagaatgttctttttaagcagtgaataatctttcactttttccctggtgaccatcagcagcaactgcaagacgactgactgagaatgtgtttacaatcatgcagtcatagataactaagctgaaagaaccctaaaaaattagtttacatccttaccttacagacaaatccctgagcgctgaattcactatgactgtaataagagcacaattaaagaaatgaaagtgattgtcatttttaaagtttcattggtgagttcccaagcatacttctatacacactaattcctctcccccaaatcaacattcctcttcatattcttaaatctctaaatcctctaagtcagcagagatgaagaaatgaagctctgattgtattgagttttgtgctggtgagacccacgtaggaaatgctcactttcatgggaccaaagggcagggatagtacatacagagagaaagttgtcacagctcatggcagacaagaatgagtatgaagtgcctggaaaggtgtcttcactagcctgtttaataatgtctgtggttatgtaaaatactcaaattatgtgtaaattatacacacaggaaaaggggaatcagaattttcatgcactgtaccagttgaaacgactcattttatcaatgctcttggtgccagagaaaatttaactacatcacagcaagttagagtcaagtctatgaaccactgattggtagaaaggctttcaagtgaatatatagcagacctggcaggttactatgaaacatttttatgtacctgatgactctcggctctcactggtgtactgccctcattgtctacttacagcatttagtaaaattatgccctaatttaagatgtggtggagatgtagtttacagaattgacaatattttaattttctctgactttggtatgttttgtttaatttttctaagttgggagataaggagaaagtactcagtaggtaaaatatgtggctcactatagaaattgaaataaataaaatgaattatatagaaaataaatagaagagagaagtccaaactcattacaaaactttgtgacacgtttctttttcttttttattagggtcttctggagtttttgggctttttgtaacctttctggagtaaagaatagagaaaaaaagtatagaaccgttgaatcagtgtttgttgtctgcttaatgtgtgccttattgggctagacattgaaagtcaagagataagtaagatgtcagatcatgatgagagtaattgctttggggtttaaaggaagtggtcctgggtgaaacaatccttggactgactcctgaggatgaataggaatgtttcgttgggccatagccacttatccagaggtctggttaggtgagtgggcttgaatttcaggcagtgaggctgggatcactttaggaaaggcccttgtagttgatctcataaaccaaccactgatgatttttaagtagagaaatgttgtgatcagtttttatttaccattctgatagtaatatgtagtctgtagattagagggagactagaaacctagacatgaggaaactattgtgatcatgcagataagatataaagaatcaagagaaatgttgtagggttgtaaaagggaatgaatttagggttttttgtttgtttgtttgttgttgtctttttgccttttctagggttgctcccgtggcatatggaggttcccaggctaggggtctaatcggaactgtagccaccagcctacgccagagccacagcaacactggatccaagccacgtctgcgacctacaccacagctcacagcaacactggatccttaacccactgagcaagatcagggatcaaacccgcaacctcacggttcctagtcagattcgttaaccattgagccacgacgggaattcctagggatggttttaaaaagaataatcaataggacttgttaattagatgttaatagtccattcagaatccctagacagtgaatgctcttcgtcacttcttgctctggctactgattagtagtttcatttaaataagcaggatagtataagagtataagaaaaattagataggggtttgcccaactggaaggacatatctaggctagaatatagttgtttttcatatttttacagtggaaaatctttctgttcttagtttgtaaaacaaacaatccatgtgataatcaacatacaattgcacatctgcaaaggtattatcttaaatgatctccattggctcatgagcagattgctgcctagtatcctctctgagagtcatagcttgacagctgagaagtgttctccctgtaaaggcacctgatttgtgtactgatcttactataggaaaaaagcctagtccttccaaaacgtggtcatgaaaagttgccagttccttatgtaggtctcaggtatatctgaaattcaaattcagctgggcaccacatattttattggcaaccctatcctatattttttgaaaaaatgctcatccttttctgtctcctcatgacctcattttataagttctagagcagaatgtaccccttaaattatgggacaggaacttcaaataaatgtgaaagatgaggttaggggaggatagtctctagtcaattccaggtacttcagacactgattcctggatttattttcggtattatcatttattgattactttacataaagccttaatgtgtttatagctcaggaagaagggtggaatagtactaacagtgccccaggtgtgttttgagcattaattagttaattatgaaacacttagttgagaggcatgctaaagagcacagaactcaaggcatttcacctcagttgggggcccacttaaataggtctttactaagccaggaaaaacaaacacaacttgtccatgaagtacatcacccactaggaaggctgatctcccagtgtgaccacttgcatgacaatatatcccttgggtgtcagagattttttaaaagcaatgattcttgaactcctggatttttcggacaatattgtgaaactatttccatctgtattcttaaatattttatgttttgggctaggaattataggtataagtggaaatgacagaatattccaaaaaatgtaagataccaaaggaggttaaggaagtggggaggaaagtggactaggaagatgggaagactggtgaaccaggtgcctaaagattttagacacactcacaatactaatgctgctggtttgtgttctctaaattcattcttattaattccaggtcattgtaatacataaacacattaaagaaaaaaaaaaaaaaaagaaaaagaaagaccaggaatcctccctatggtgtagtaggttaagaatccaactgcaacagctctggttgctgccaaggtatggttcgatgcctggcccagcacggtgggttaaaggatctggcactgccacagctgtgattgaatccctggcctggggggcacttccatatgctgcgggtgtagccattaaaaggaaggaaggaaggaaggaaggaaggaaggaaggaaggaaggaaggaagaaaggaagaaagaaaagaaagaaagaaagaaaaagaaagaaagaaagaaagaaagaaagaaagaaagaaagaaagaaagaaagaaagaaagaaagaaagaaaaggaagaaagaaaaggaagaaaggaggggaaaaaagaagaaaagaaaactcaaagtatcagcaaaattgatgagaaatgtggcagacatgtgggtgactcagccccagtcccagttccccatcctaatcctcagatgaaatatccagctcttcaaactgaatcctgtccagtctgaggcttacatgatttgcatgattttctcagcactattgtacaaatgtccattttgctatatttttgttgtctttctgagtttttccctctcttggcttttccaccttgtgttagaagccatatacttcaacatgtatgtttatatattatattccgctttcattgagctcgattcccacccaaacccatgctttagagagaacaatgacaggcttctctgcacctgtttcatgtttagtaagtttccaattccttttggtgtcaaacaatagcaggtacctctgtagtccctcaggtcacttgtgtgcttggttttgttgtcaaggtagcaactgaactgtatctttcacaaacaggtgataaatttttttctagttgggcagagtacctcccattcattaggagaaatgcccctagaggcccatctctatgtcatcgacatggcagtgtatactttaaagtgtctaaattgtacaggattttctattatacagtattgaattgctttaaaatgttaagtatcttagtaaaataaatcctcttactttgttgaggtgaattaaaggtattcatgaagtttccccaaggcaagactgaaaagatctatgagaaatgccaagtcatggcatttcatttggggggaaaaagagaaaagttctgtataaaagattcatgatctttggtattaaattttggaagttatggagttcccgttgtggctcagtggaaatgaatctgactagcatccatgaggatgcaggtttgatcgctggcctcgctcagtgggttaaggatccggtgctgccatgagctgtgatgtaggtcatagacacggcttggatctgggattgctgtggctgtggtgtaggccggcagctacagctcccattcaacacctagccagggaacctccatatgctgagggtgtggacctaaaataaaaataaaaaataaataaataaataaataaataataaattttggaagttgagaatagacctaaataatgaggagattttttgttgatctgttccattttttttttaaagcacctgaccaagcccatggcctttttgagaaactaaggcaggaaggagggggcaagtgttagggcatcattgatccttctttctatgtttgtttacacgtggtaagacaaattacctcccacagcagcacaggttaatcaagaggctcagaggagcaggagaatgagacactcattgatgttttttcagtgcagaattctctatcttggtggttgtaaggcagatgatgagaacaccctagcccataaatcccagcaagcagacctaatgacacagaacttcatcatgggttccatggtggccgtttaagtgcagaatgctcccaaggttcaaggaggatgatggggctacttgtttttcaataatactgggaaatctaattcataatatctgtgtttaaacagtcttatttctaatgggttagaacttctagctttagagaatgttttcttggggtgaattaaaaactacaggatagcaccattagccttatttggggaggagctggtaggaggggaaaacataaccaaggatgtcagcctcattcctcatcacagcacatggaaccctgggagctcagggagaaggaaatcaacaaatactttcaccttcaacgggaccttctggcaaatgtatatggttgtttttgtttggtcattttggggtttttttgtttgattgttttttaaaaattcctccgtttatttgaaatacctgtttgtattgtttgttttcttataacttatgcctttatgtcaatcagttgccctttttccataggtttgtttttccagagagaactcagtttagcctgcctgcccctttctagtagtattagaggaacttctctgtctccatgaaatggaatgaaaataataatgcatctgtagtgtttctgaaaatattacatgtctaacacagtacttaacactgagtagctgcttgctctctctctctctaaatgtgtatatataatatatattctaatatatatatagtctcctatcactgactaattttctaagccatgcataacacaactcagtaccaattttgtcataaaatgacctaaatttagcctgagaacagatattcaagaaaaaaatttgcatactactaaatcaagatatgtattatccagcagcaatttgcctggctattcttctatacagatgagagctgagtctctgtttaggccacttgatacctatcttacgtggcagctgtgatattttaactcctgcagtaattaggggtatatttgcaatacagtcagctccaatctaatttatcaattttatgaggtctgaagcatggtcagagctccctttggtgccttgaagcaaagctgcttgccaagataacaaagggcatgactcagcggctttctgacttagacgctcctgtttcacatcagacacagagaattttatgtttagcgaccttctcctcccacttattttggattttctcatctaaaagcacagctgtgacatcagcaatggaaatttccatctctgggcttgttatcttgattagtgtttcctgcttgcacaaaggattttaggtggctttccataaaacacatatgaaagggatcactaaaaggaatttcaaaattaattagatattctttgcagtgaagaaaacaatacaaacagcaggaaattttgtttcatctttgacacaaggtctaccacatactgatgaatgactagtgtgatgatggtttataggctcagatacatcttaagattcattctctagttttttgaccaagtccaatactcttataaggttgaatgattctgatgacagataactaggacccctttctaaaccaatgtaaaaaattacaaatccttcatttcaaaaagatatattctcaccaaaaggctttattttgtggtttctcatgtttcacatttctgttaactcctaggtaatggttattggtatctttattagcagtggttgttaggttcaaatgaaataatggatgctaaagatctttataaagttaaaaatacatcaaaatatggttttaatgatgcttcatttatttgaaataatatgcgattaataatttttcaattaatatttatctgtgccagtttagtttggttgatggaaatatgatactactaagctaatgcaatgagttggatctatataggaacacttagcatttatttctccacagaaagacatattatattctcaggcaattctccttgaccctagctgattaaccacataagcatagaattgaaccttagagagggttcttggttcggcacccctctcagcactttattttataaagtatctatataaaatgatggctttatatacattatctgatgtaatgcacacaataacatgaggaaaggcactattgtcatctctacttcttagatcagtagacctgatcttactctattaaagacagtagtccacttgtccatcatacacagccagaaaatgatgaagctggacttcagatgctgatatgtctgactcagagttcctaatacagtgtatgttcctcagaccaaagactctctcagctgattttgaaatgtgtggaataattcttagagggggaaaaagtgagattttatttaattttttccctttcccagaagaggtatctacatcaactgggacctttttttgaaacacacacaatttccagttgtataaaatattggcatctgttaatatctcctaaaagcttggggttttcatatgtagagacttcttcttttctaagtaaaacattagtcatcattctaaatgggttatccccaaaatgtattttcctgctgtaaaaccagcaaaatatgacaaaaaattttatgtgctcttggtcttataattatttcatataaataagactcttcatccgcactaaattatgttattaatttcacaacacctagaaagatgttatacagaaaatgttaccatcaattttgatgttgaaaaaaaatgctagttttagaaccaaaagtactctgtgcactaaaagtatttttgcagtacgaaggtaggaatagatgggaacatgtttttcagagctctccagggaagttttagtggtgatgtgagctagtcaaagaaattacgatttggatgtgggaaaggcataatctgtggtctccaagtggattacgcacatctaagaaggatactggaagacttttttacattcttgtctttaaattttcaatcttatacatatttttaatgtatataatgttttatagttgcatgtgtagattttttaaaaattagccatagtatttggaaatgctcactttattgttagtattattttgccagtaaaactgagtctggaacattttcgtaatgataaagattgcaaacgtgatcctgtaagtatcaccattttaagaaaatgcagaaaaaataactgcagaaattgactgctggcatgttgtaggggaaacaattggcctagagcatcagaaagttaccagacatgtggagttcccttcatggctcagttgttaatgaacccgactaggatccatgaggatgcaggttggatccctggccttgctcagtgggttaaggatccggcgttgctatgagctgtggtgtaggtcgcagatgcagcttggatcctgtggtgctatggctgtggaggaggccagcagctgtagctctcattcagtccctaacctgggaacttccatatgccttgggtgcggccctaaaaaaaccaaaaacgaaaaaaaatagttatcagacacaaatgtctccttatggcagtgactgaattgattggacctaccacggatttaaatcatttgtgttccctgcacaaacatggaataacccaggaattctaaatcactttaaagtaagtataatgtattactagtattatatattctacatgtaggtgttcatctatgtttatttgctctaccttttttctgtttgtaagacatcataatttcccacatgtcaaggtcagtatcttcctgacaagatttttgtgaagtatacacagtcatcactcaattgattattattttgatagatatttatgccacgcagagagaaataagtctgagacatttcctatgattgacctcattattctgcaagtatgcttacaaggcaataacaaagagaccagaatctcttagtttttttaaagttaaaaccaagacttgcctcgtatttcctgaatgaaatggcgggttaatgttattgatgaaatgattatggcttggcttccttgaaacgtaagctgttagtaaaaaagcaattagaaaaataataaagaaatgaaacagcaattcctctgtcatttttccattcctctgtattgtgtcataagcaaaagtaatataatagccactaattataggaaacttctcagacttagtaattggatctctcattttccccccagcaactgtgaactaagaataatatttgcagataggcctccttcattcccatgaactcttatcagtgtctctttctgagagctttaaaaaaaaaaaaaaagattcatgtacatatttagacatattggctaaactaatgcttttttttttttaaagaacaaatatctttaggtttattattgcagttcttccaccatctattagcaaaatgacctattttaagcagaatgaatggaggaaggcactgaaatcaaagtcatagctccaatattttcttaacataactttgcaaatgctaaactataagcctcgatgtcaccattttttttaaaaaaagaaagtatatttgcattttgtatttcagagattgctgtatgagaaagagctgtgaaaattataaaatcattgtaatacagtatatctttatatatgtataagtgtatgtttttcttgatttggaaatgtttttaaaattttttcccctaaaaatgagctatcaattaagagatattttcaacagacattatttctttagaaattgacatattaatgtctgtgaaaaaaaacaaaaaaaaatatagatataaaagtaagatatagaacaaatacacagtaccatattcttggcataaatttgtacatcaagaaataaactttataatgtgatgagaacactgaacctaaagcctgataaaataaaaattagaaaaccaagaatcagtatgagttgaaagagagaaaataaaactgagtgggaagtagtggtgggatcgatgtggaaataatatttaggaaaataccgtgatgaattaactcttttcttccttaacctgcagagccaccagggaactacttaagatttttttttaatgctaatatcaactttcttctttgaggtggtgaatttacagttaattagtgaatacataatgaagacatgtagatgcaatgggctcaattttgaggtatatatatttatttaagtatatatacttaatgtcaaatatcgggaagaaagataatagatttaagaaggttctcttcataaattccttaacactttggagtgggggtctgtacaaatacaaggacctgtagatttgttgtacctcaacaaaatctgagaaaatgcacttccttctcaaggcatttctttaatagtcccttagcctcacctatttttgcatatttattaatctataaattcagtaaatctaaattacaaatttagaaattcccaaattatgttgctgttaataaaagattactgtctatgaaatgagccttttctgtgagattgagtatcagagagtttgcatattacttgttcatgcctttaaggaaggcgagagcaacctgcctgtcattttaaatttgcttttcaaagagcagtgggacagaaatgtgacataagcacaccaacaaagtgtagcttctaggtgttactgatgggtaggcattcctcaatgaagtgtctgggattgttttatttaattacaaaggcagtttactagataaactgctccctgattgaatttctaaactcaagcctgctgtgcaaagacaaatgagtcatcaattaaaaacttcagtgattcagatgcggagacctttgtgacaggtacacagtctaagccattgacttctgcattttcaacttttaaaaagcacagacctctgaccttttttctaccttggacggggatcagcagatcttagtcctactcctggctctcctattcacagccctgtcgttttggacaaagtaattctctaattgacacttcaatttctgtatttgtgaattgagagttctgatgtagatgttctctaaattccaatcactttagggcagtattttttgaattttatttttatttttttgctttttcatcaaattctttttgaaaaaattttattagagtatagttgatttacagtcctgtcaatttctgctcttcacctgatatatatgtgtatatacatacacacacacacacacatatatatatttatgttctcttccgtcatggcctagcccaagaaactggatataattccctgtggtatatggtaggaccttattgtttatccattctaaatgtagtttgcatctactcttcccaaactcccagtccatcccactccctctcccctcccccttggcaagcacaagtctgctctgtatgtctgagtctgtttctattttgtagataggtttgtttgtgccatatttttgatttcacataaaagtgatatcatatggtatttgtctttctcttttctgacttatttcactagagattctcatactaagtagagtagtattattaaatgggattagtgaattgtagcatgtagatttaacatatacacatacaaacatcatgagactagactagaagagagaatatcagtattacttgtagtaagaataaatactgtttgtgaaattttgtttcagatataagtaaacatgtttactcagccacagtgtaaaatatagtttgcgctatgggtcacagtcaagaattaccagaatttctctagaatcttaactttttcactgtgtttataatggttggttcacaaataaaaacttaaataactcctgtttccattatagaattttaattgtcacagccttaaaaatgtcatgccccaaacaatgaactcccaaataaagccaatacaaaccaggataattcgtgcctggaatatgtatgatacaggtttttttgattatctgccttaagtatggtcatggaaaagcagaatgtgttcaaggcaataaaaagtattttgccctgttaaggtgaggtgaatttttaagtatttgctgagtcctgaaagtccagttgatgcttaagttttaatgttggctttgctgcaccctgttcctttctgaataatgagtctgataattgccatctgagatttgcatattaaatcaagatgattagtaactgttgagcttcagtagatagtaattaatgtagccttcttaaagtgttaaaattgtctttttatttctaagctgtaaaatagattttagtactattggtctcggaatacttcaattaggaagaattgctttaatatagccatttatgtaaagaccattaggaccaaggtctgtgtgcactataattgttgatattacctctcagagttcccgttgtggctcagtggttaatgaacccaactagtatccttgaggatgcatgttagatccctggccttaagggtgggttaaggatctagtgttaccttgagttgtggtgtagtttggtgacacagctcccatctggagttgctgtggctgtggcataggccagcggctccaattggacccctaatctgggaacctccgtatgccacaggtgtagccctaaaaataaataagataaaataaacaaaacaaaataaaatgaaatgaaatattacttctggattcattggtatattccatgggattttcttattagtacaactgatatttttctgtcccttaaacctcctctcgaatggcacctaagatgtagttgctctgtgccttattcttctctttgaaaaaatagtactaattatggtattaaagttttcaaatattggatgtttttatagccctctgtagttcataaagactgtttcttaagaaaaataaaccaagataacatgtcaaacactaggataattttttttttattttattgaagtttagctgatttactgtgttgtgttaatttctgatgtacagcaaagtgattcagttctacatatgatattcttttccatccatggtttattatagaatattgaatatagttccctgtgctatacagtagagccttattgtttatgcatccaatctgtagtagtttgcatgagtaagattatttttttaaattaggcataattatgaaaaatgaaataaagtttgataaatgtaaaagagcagaagcaagtaaaatgtgtttcactgttgtatatactgctgtgaagaattttatttaatcatcttaatttaatatgaatccaattaatattactgaatttgatagttattcaatattgttttagtatcatttggaattagattcagctgctaataatagcgacctgaacatagttgcttaaattcccaggttttatgttttcacttaatagaagcccaagctagacactcaggactggtttggtggctggacaaaatcactgagtacccacttttatcttcttgctctcttattcctgacttccagcctgaaggtcactttgtagtccaagatggttgttggagtgctaacatccaaactgaaggcagaaaggagggaggactcagcctctccctttacaggcttctgcgaggaagttccattaacacttcttacatttattcagtcagagctagtcacacccctacctatgagaaaacctgagtagtagaatttcttaattgtgggcagtttacccaggactctcatgcaaagaagtgagagtgaatatgagaacacatatatttcctcttttattccaaataatgcgcccattttaggttttttatttttcaaaaagaggtctcattatcaagtaatactgaaggattaattaaataatcgattgcaaacaccttactttttattcaaaacaagttaaacagttaaacatattctgaataatattaaaaattcagaaaaggagttcctgtcatggcgcagtggttaatgaatccgactagcaaccatgaggttgtgtggtcgatccctgcccttgctcagtgggttaaggataggtgttgccgtgagctgtggtgtaggtcgcagatccagcttggatcccatgttgctgtggctctggtgtaggccggtggctacagctccgattggacccctggcctgggaacctccatatgccacgggagcggccctagaaaaggcaaaaagacaaaaaaaaaaaaaaaaattcagaaaagctatttaaataagatttttagaccagaaaagaacttaaagatcatcttctaacttgtacattcctcaagtagggtaaatggctctaggataaactgagtgacccactcagggtctcataggtgatgagaaatggagcctagacctgaatatatgcttcttaagtctccaaatggtactcttcctactacatggtggtctttattaaccaagcgatgctttattttgaatcctgcttctttaagaagaacattagaatgtaaatattttagcatctatgtaaatcagatcaaaaaaggacagtttacatagggatactttttaagctttattcctaggaaggaaaagtgtcagaaacatgctcttgaattgtattacagtttatttataagacatttgttatgaattcagaatacatttttctgtaaagaatatatagtatttccacaactggcttatggaagcccataacccttgatatacatgcagtagtatacagataatagtataaacttagccattctatttcacttgttcaatacatatttaatgtacatcagcatcatgttccaggtagcgctgtgctttatatttgggacacaacagacttggtcactatccgcacagaatttaccatgtggccaagaggacatattaagtgaatacttcaaagtgtgatgagtgctttcactgaaaagagccaggtcctaaagaaacactttagctagaggatataggagtaaattgcattgtgaggggagatgtgagcaaacaaaaaggggcaaaaaggtaaacagtcctaccctccaacccctacttgactctgagaattgatactgatttctaaaaagagaagaactagagtcataaaaagattctggtttttgttttttgggttttgagggagttgtttttagaagaatacattgaatgaatcctctctgctatcccctggcatccagcttagaaatttcattctctttcatttttttcccttttctcttatatatgtgtttgtacatcacaacctgctttgtagcctaagaagcttccagcccctgtgggcaaaaggttaacttgatgatttcccatgctccatgacacttcgaccttcagttagcttactcactctgtttccttggaaacagataaagatgtatgaatgctgttaccaaattgcatggcttttgttagtagagacctctgagatatagatgatcagaaactggcaaacaccaccgtaataactattgcagaaaagatccacaggtgtatgttaaaatgattgggcaaatgtttgaagagaaaccaatttccatattctaaactatgtccccaagataattaacaacaaaggcaaagctagtgacttgatagtggagaaacttggaaggccccagctaaatcaagtgattaaggtaaacatctctaataataagatacatggacatcaagaaccactgatgtccaccacctgagaaggacatagctttttttttttcagtattcttataaaaaaatttataaagtactccagccatgtacagtcatggtacaaacccaaattgaggggcatgtaaaataacagattaatattcttccaaagtgcagtggtcatgaaagaaaagataaggctggggaattgttgcagacaaaacgagactgaggagaaagaataagtgcagtgaaaaaaattaacgaaatttcagtaaggtctgcagtgtggggaataatattttactgatgttaattttctgttcttgttaattacactatattatgtaagttattaacattatcagaagtgagatgaggtgtatagggaatttttttatattactttactccttttctgtatgtttaaaattagttcaaaataaaaagtttaagaaataaagctgcatagagaggagaaaacataaaagtttgtgctattgtacacatgtactttatttttttttgtacacatatactttagatgggttgtaataataacctctggagttgtataagttaaatgtaaagaacactgaaacaagaggaaaaatgatccctgattggtctagcccatctgagaagggagaactaaaagtgtctgatggggttgtctttcttgggccactgttcaccagggatatgtaagtgggcatgctccttttagacagagttgttaaaactgatattggcccatgtgaaacatgtggcttcaaatgagggtgattcctatgcgtgctcaatgtggacctcatctcctagtacttgtatacctgtgctgcattcatcgccatgaaaattgctgaaaagactccctcccgtaagaaggaatgctcatcactactactctgctagcaaattctggttcatgttatctgttcttgggtatagcgctaccaagtactccatagacctcctgtgatttccttaatgggctctgtgtgttttaatgcatcaatgcctttgttcattttgctccttctgcttaattaataatgataatagaaacaatcatcataggcatttattaaggtcttactgtttcagatgtgattttgaagagtttatattttgttaactcatttagttctcgatcatcctttccatactcattttacagatgaggaaattgagatgcccaattaagtaatttgaccaaagcgacatagcttttaagtcttgaagtcagattaaaaaagaaggtatcctggctcatacagtccagcctttagaaatctacattcagtcatgtacttctgtagaagtctgacttatctttcctctacaaactcaaacccacttctacttccttgtgttccaaagtactttttaaacgtttccgttcaagtaattatatcatcccttatattttggtgatttgtgtataagtctttcttaaaggctgctaatctttcgagggtcaaaatttttctgctcagtgtcaggtaggtcttcatgctggtgactccaaagtgactgtttccaatccaggatcatgtattgagttccaaaatgacattgctaactacctgtgtgctttatgtctctaggcatctcagacacattatgaccaaacctggacccatcatctttctcccttatttatgcctcatcctcctagttttcctaccttaagaaattatgggaacatttacttggttgtccaagtcagatacctgaaagtaatccttgattttcatctcattcctagagtcccacattcaagtgtcaatgctgactctacttcatctctcaaatatgaccacacctctatacttcaatatgctacagtttcacattcatttgctagctgctctctctgctgtaaattcaccgtctatactgtgagagacatgagctttataaaatacagatttgaccattttcctacttaaatcaattcatagtcattgcgactaccttctgcaacccccgtttctctccactttattttttcaaggatatggttcctttaaaaataatggaggagttcctgttgtgactcagaggtaataaaaccaactggtatccatgaggaagcaggttgcatccctggccttgctcagtgcgttaaggatctggcattgctctgagctgtggtgtaggtcgaaagactcagctcagatcctgcattgttgtggctgtggtgtagtttcgggcagttgctgctccaattagattcctagcctggttagcagcgtgcctagactcttcctactagatgcccataacaagcactcctccctcttatagagttaggagttaatcataaatattgtacttcttttggtggtgataagtataatttggtggtgtgttgttttttcagggttgaagcaaaatacaaatgtctctggatagttggctcttctgccattggaaaaacatcggatgtcctttatattgacagtaaagtaattgtcacgaaattgttttcttattttagaattctattcaaacagaatggttaaggatttttgtaattttgtacgcattccttattctttagttctcttgcattttaaaaattagagtctctagcaaatacaatggagagaatccttagctgtttaagcactgaaatcatactttcattctgaaaaggccctaaaaattcttgctgactttttaaataactcattgagtaaaacctacttgttttctgtttatggttttcagtatctctttgaagtaggattatgcagtttgaaagaagggtaaagagtattactgaagggttccactgcttaaaagaacttgttgaatgtaccaaagaaaaagttaatgaaaatgtttttccttagatgtcaaggctatttttaaaagagacaatattacttaggaacaaatgggaaaataatgtcttaaagtggatgattattatggtagttgttatgactatattttgaaatggattttctcttttgaagaatatgaatgttgttaaatactcttttagaacaggggtaactggcatcatgtatagtcaaaagaaaaaaaaattcatagcaatgctcttgtgtgtcagtggacaacattttaaaatgtcacagatcaagagagacaatttaatcctgaaaaatccaaaagcaaattatgtcatgaaaaatagtattatgcacttcaaagaaataccaaggctcagagttgttaactttatattaatatgtgttcagtatcccagcttgtaaggttaatgttgaacatattttcttattaatgaatgttcagtggacaaaaaaacaaaataagatgacaagaacactgtgcagatatgttacaatgtaaatggaacatagactctaactgcaaggaattttataagaaaattctcaaaacaaggaactgttaatgaaaatcaaattgtcaaaaaatactcaggaaagagatataatttagatactgataatttatttcagataaacaatgaatgaatttttagaataagtatatatgttttctttatcttgaaatgtgcatagacaattagaaacaatttaatttaactcaatgttgtgactttttatttgctaactttcgcaactctacctgagatggtgggtaggcaagaaattgcccccttgagagaccgactagtttagatcaagatcaaatatagaccattctaatgattattatttaaatcactttgctattaacctttatatttctcattatcacaatatttctatatgtcccagactttcttgagtatgaaagactataaatgttttcttttgaactgtatgaaaaatgtcattttaaaagaaaatttaattttcaagtattttaatcacctagccaaactgccctgtctaaaattagcttgttcttgtcataacctagtttccacagtgagtcagaagtaatttccccatattaaacaagaagattggttgaaagcaagagaagtaaacattggctgtgtcaagccaaagggagatttatgggaaggttctggatcctcacacttcactggaatctttgggaagcaggatgagctggttggagaaatgagcagacagagccaaggcagggctagaggctttttggcagactcctctggccaggccaggactgctgtatgatgtgccacaattagactccactgtagttacataagggttctagcaaaaattccaacctggccttacttcatcttggcttcactcattccaggatcaaagtaagggggaaattaatctatatggctaagttaaggaggtgtggactctccatactaatgagaatagaaaggaagaatcattcgccttagatttccacagtaagagatgaggctcgagtcccatcaccacctctttttagaggaaatctctgttcatctcaattaggaaggaagattggctgttgggtgtaaatataaataaacatatagatttatattcatatagatttatagtcacacctatgatttgctcttgcttttgggttacaaatgaagcaggaattcccttcagtgggttaaggatccagtgttgtcactggtgtaactcaggtcactgttgtgtcatgcattcagtccctggccctgcaattccacatgttgtaggtgtggccaaaaaatgaaacaaattaatatctgattatgtaagattgatcaggtatgtgcagtcagacatagagtgactgaaaggctagaatagttatatgcttgaagcaaaggaagacattttacctcaagtagtataacttttacattttacatttgaatttaagacatttaatggcaatggatagtcccttctccccaagttgatagataatttgtgctgcttttctaacttatgaagttgtaattctatagtatggtgaattcccaagtgatttagacccaactatgcctattctctaatttgagaagtgtgctatgaagtagtatattatgaagagataaaatgagtgtaaaaggtaatgccctaaaaggtagattacctttaaaagaagcaaataaaatcgaaggcatggcattttgtctttttttatcgttgaattcccagatcttactcagtgtctgacataaagtgtttactcatactctatattggtgctccaagaaaagaaaaataaatagaaggagaaagaaaattgtcattattttcttggaagatatgaccatccattcagaaagcataattgataaactgttagaaatgataactaaagatcatacaatataaagttaaatcagtagcagttaccaattggaaaataaatgtttttaaaaaaataggacgccgttaataatagcaacataaacccagtcagtatctagaattaattcattaatttaactaggaatatacagatccttctgtagaaaaagctaaactctaataagggacatagaaaattatctacctcattaatgagtctttctgtgcttccagatggaataacaaatactataaaggtataaatccttcataaattattctttgtttcaattggctttttggagaaattgataagatagaagaataaataatcatatataggtaagtttacctcaagtaaagagaaaagggaggacatgtctcactatgcaggaagacataccacaagaaatctttgtaggaggagggctaatgaagcctatatgtagcactactttcaaaatattaaagtaagaccaattagagatacctgttcagtgaagaaaagataacactgatgaagttaatgatagaagatatttacaattctgaaactagggtattacaatctagtgtatacagggaacacttaccaatcaaccagtaaaaaacaacagtcataacagaaaaatcaggaaaaggataagaaaaagaattcacttaaacccaaaaagtgagcaggcataccaagagatgatcagaatgagtatagaccaaagcagtgctaactcaatttaaaaagtgatagatttttcacctattattctgataaaatttggaaaactctttgaatgccacgttagtgaggatgtagagatgcagaaccttcatgcactctggtgggagaatagaaaagtgcagccattctggagaagaatgtggcattacttagtctaattaaatatgtatgtaccctaggaaccagtatggtatattccctaccttaggagataggaattcttatacagccgcataaagggacacatacaaattgtttatgacactgttttttttttttgtggtggtgatggaagtgagtttactgaggaagtcacgaagtttaagctaggaggagccttagcaatgtgttttcacattatctactttggtaagatttacaaaataagatattttaactattactataaatttccctcctatcaagtagtattggagtagccatggccatatctggtgtgcagcaaagagatgctgagttggaggtactttcaagttcatttttaaagtttataggccacttccacatacatttatgacacactcttataaaaacactaaatatgtagaacagggatcatgttcagctccttcctttaatcttgccagagaagaaaactgccttcccattacctgaaatcatgattcctttggtatttttcaacagttatgtggtttttttttttttttttgctctcggtcacattttatagatgacatattttaaacttgaatgccaatttggagttttcttttatgtactttgctttttataaagctttccaagctacatgaaatagatgcaatgaaattctaaaatatatccttaatatgtaccttgggtttctcaagaaatccaaaaatacaaatgaggtacagaatattcacaaacacagtaaagctcaaatatgacaggttaggtgtaatttagaaagatatataagaatactttaagttaaaaattacacattactgaatatatctaatatctgtataaatgcaaaaagcacccttttcatctttaactttttgaattaaggtgttgagagaaaattcatatacaaaattagtggaatatgaaacgtaaattataaagagcaaggaaatcattattttaacattgaacaatgaaataccacaaaaccttttgtcatatcagaagtaaaagtaagaatttttgtcattatttcactaaaaggaagaggtgaatttctaatagaagaatttaaaaagctcttgtattgtttgttaatccacttaatgaaaggtgaatcatataaatatgttgaggaaataaaaagacttaagtttcttgatggtttgccatgaaatacccaaacacatgatataaaatgaaattcatcatatatcactacatcgagaacattgatgacaaagtggctaataatgggtgttgtcaattcagagtatttaagattagccattgatcaaggatactcaaatgctctggtatcttacagctcgtatgtgaaaggaactttatggaggttttcccaaatttgacaataatactaaaaagttactttctattaccaattttactggccataatgtggggagattaactctccaaatctcaggttaaaacaaacaaacaaaaaactatggaattcagggatggttgatgtaatccacaatataactaaattatgatttcatctttttttcttttcgtttttcagtcctgtggggagattaactctccaaatctcaggttaaaacaaacaaacaaaaaactatggaattcagggatggttgatgtaatccacaatataactaaattatgatttcatctttttttcttttcgtttttcagccacacctgctgcatatggaaattccagggctaggggttcaatcggagctgcatctgctgctccagcacagccatgtgccacagccatgacaatgccagatactcaacccactgagtgaggccagggatcaaacctgcatcctcatagagacaacatcaggtccttagcccactgagccaaataggaactcctaatttcatctttgtaagcttcttgcaaactatttaaaattttaaattagaatagcttgagattagataaatccaggaatagaatctaaagagtttatgaggttatacatttcagattccatggaaaaatcatcactaagatgatttcttcgtgttgagaaaagcttgagtgtgatgaagatgatcaggctggacaaacctaaaaaatggcaaagacagttcctggaccatagtaagcacctaacagtcctatgaatgaagagttccaagggagaagatttactggggatacaagttgtagtacagatcagccaccttctactcatctttcctccttgactaaaatctcccttccaaagcccaggtcagttgcctttcccgtatagtctcattattttgtgtgataggagaattgcaattgtttgcctgccgtattccccggttgactgaaggtcccagaggacaagaccaagctgcctagcttgtatttgtatctccagaacctggcattgtgtttgctcttagtaatcactttaaaaatatttgttgagcagtaagtaaaatggaatgaacatattacaggaatattggcaccgtattatttcacatacttaacaatgcagtatgcattcttttgtgtaacctactggtggtggtcttaaaatcaggattatcttcagtttgtttgagtaatttgaatgatgaggaattgttaattcctaagtattcctgctttagtcttttatagcttaatacagaaagatctccaatgcacattctgttaattctgctggcaagttattatgaaggcatttaaaagtaatacacataataacattgaaaataatttaactgatagctcgtcatttaaaattcattctctaattacttttcagttattgaaggctctttcaaaataaggctactttgaaaaaaagtaatatatatacaacagtatacactaagggttttccgtggacagtgttttctgcacaacagagaaaaagattccatctactttttttaaaaaaaacctgagaacaattaccttataataaaaccacaaaaatgtgcagactgaaataaataaaaatcaaataagataagagggattctggtttgtatgtataaacagtgatggatttaagaaaatatacaaatgatggatttaagaaaatatataaactggaattcatacatgcattcatacacgcattttattctacaaagtcttaaaatccataatctataatcattattgctttgtatagtcattgttcatttttgttgtcagtttttccttttatatacacagaaacatactcattctgatgtgcatttttctctgcatttccattcttcttcccttagagtcgtcttctgcctagaaacttactttggtgtgtattttagtgcagtaatgaattatatcagtttctgtcttctgaaaaaggtttttaaatttcacatccatctttttaaacctttcatgaagtacaatatacttatgaaaaatacatgtatcctaaatacatagtccaatgaattcttccagactaaatgaatcactcaaccaaccctgggataaaagcacagaactcctcactctagacggatatttttacttcctctcatgttctggattgtcaaagatctcaggcttcaaaatcaagtggtaggtctttgttctagacacaattacagactaaggatacactgccctgtaggataacataatgttagaggttcccagagacatctaattttaataatcagtcaagagtcaagtgaagctgtatatttatgggctgtagttaaatggtgacagagataagtgcactaacccacctcctaaggaaaagctccttggcacttatatgaggaatgaataggagttatcagagcttggggttggggagagttaccctgcttcaaactagctttttagtaaaatgcactagataaatccacaatgaagatagataattaactgataaagtactatatttgactctacttctgatgacattgtaagaaactatataaagttaaaagcaaattgaggaaatagaggagtgtatgtagatccataaagacgggtcttaattctactctacttactacctacttaaatgaaaagttttgggtgaattttaaaatttcacataacgaaataaataacatgaatatcttctaaatccctacagccactagttttactgaaccttggcctgcaaagggtaagataaagcatcagagatagagcagttgacagtgtgaaaatttgtacaattttcagaaatgatgaactgattgatattcaaggcatgttggaaggtctgccaaaattagagctaaggaaatatgtatttgttttgatcaaactaaggcagaagtttcaagagagcaaattaaaagattagtcaagggatttcatagatcctttattgcacattaaatgtgatgccaagcagtgtttggatacaactcctggtgcctccagcctggagttgggaatcttcagttgtctgaggtcccaggctctaaaactccttgagatgccttttaagcaaggcacaggatttccaaacagtcggcaatgtcagtatgactaaatcttaagaatttaacatttaagttctacttatctttattttagtgctgctatgcagtcatgactcccatcttttagtgatgcacacaataactgtggcataccttgatgaataatgaccaagacaattagtcttatatgctcccgttaaaaagaagtattacaagtcagtgccttgtaaggatcttaggtcctttttggtaatttctcctaggatgtctcagaagtaagataagcatatatcagacctgatgtatgtctgttgccttggtgtgtgatgtgagatggcatttactcttcacaaaataaaagaaaaaaatattgctttgcaacacaggtgctgtggtcatcctaccaaggatgaaaccaaatttgtaagtgccttctctacagccaagacatatctgtcttttgccttcctccagtgatgtgatcaggtgttcacatatcagtaaaatgaattgagaggccttctaattacaattcagggagcagtcaggactggactctaacctggtttaattattactttttccctgtgtactccagattcatcctccagcagcttttactttcttatgtaagtagtggagctattggatgactagtttgcatatcttcttgtctttgaatgtttcagcttcatcttctctgctattgacatacaggatttgtatgattaggttttcttctcgtgtactgaagtcgagtgtaggaaggatcctttggtgccgcaatatgtacagcataagtttcatactcatctggaagtttttcatttatcatgaaagagctttatatccttacagttcatattggaaataaatgttgcctctccctctctcctgattatgtctctctcttctatcatgggagtttagattttatgaatagaaaaattgtaaaggagatgtcactgagcttaggagaggatttttaaatgctatggtggcaaaagaggactttgttataagaaatgagtaagtatactcctgacagccagaatgcagttgtctcttgtcttgtttattgttaccaggtattgagatgtcagtaaagtgagaatttctgagtcaaatagatttccttcattgcattgttacccacagttcctagagtaatccagaaaccaaaggagagcctattgtaccttaacagcatcattacatcagatatctaataaagacttaatttcacaacttaaaaattatttgatatacttaatactaccgaatgagttaaattatccttattctaaaggaaaacacatatgaataccttatagatgaattttctagcctacttagtcataatgatctcaaggataattagggctcagacattgtgactccagtctagttctgtgtttataaactgtaaattcattccttacccaagagggcatatgtataaaaattaccctcccaagcataataactttaaaaattgatcagtatttctaacagatctcctgtttttcaaagtaatgctgttttatactgggtaaagtattatttttatatattaattatagcccattttaattaaaagtagttcagatctgtcagtctgttatcacttaggtacattctaaataatggcaatgtttttgtttgataaaatcaaatttactgagatattgaaaactttccattatattagtgtgattatacacctgtggtttctttatttttaaaaaaactttttatcttggagttgttttagatttatggaaaaattatgcaggtagtacagagagttcccatgtactccatgcccactttatcttttattaataatttacacttttatggtgtatttaatgaagcagttgatgcaattaatgaagccataataacacattattgttattaactaatgcccttattaaacagatttccccaagttttccccactgcctttttttctcatccaagattctacacaggataccacattacatttaatcatcaaatctccttagatttttgtagactatggcagtccctcagactttccttgtttttgataactttaatgatttgaaggagtactgatcaggtgtttttagaatgtctctaatttgggattttctaatgtttctcattatttagataaaaatcataagttcagatatcaagggaacatagtatcaacatgagttatcattgttgatgtgaggtgtaatctattttaaaataccctttaaaatgctcatgaatctcatagtgtcttgagacactatgaatctcatagtgtcttgagaaggctttgaaaatgagtggtactccagtcaaaatcttatctgtgagaaaatattactatttgtttccagacaagtaacattttcaaagcacttcttcatttgacagcagtgagtatcaataaaacattcctttttacttattttacattcatctactgtcttaaataatttatatttaacctaagttgattaagattttggcagatcttcaaaatggtttattggcccaatcttaatttcatataaatagaatttaagttagctacaggtaagagattcagtgatggaatatgagacagagatgtagattattatagaattataagctagtaatttttctcttgctcctcaaaataaggaagtgtcatattggttcctccaatcaaagttaaagaaataaaaaatttgggagttcctgttgtggctcagtgggtcacaaacctgccaactagtatccgtgaggattcaggctctagccctagccctaaaaagcaaaaaaaaaaaaaagagagagaaaagtaagatactcaaatattcacatatcacctgctttctacaatggtgaaagttgtcacatgaaacattgctaaagcaattctataagaaatattttaaaagaatagttaattctattttaaaatatatattacatgtgtaaggcaaagtatactgataatcattataaaagcacaactcatataacaaaattattggacacagggtacacatagcccacatgaactacaatagatttgacactctgacattagtaagtcaattgggaactgcagtttagagttccaatatgaggcacctgacatgagactaggatgataatagaggctactgagacctttgccagcttaagataatgggcataccccacatttctgtgttttagccttttaagaattggtgttggggttcacgtcattgatttctgggagattcccaatttggactgtaaacagctaaggaaacccacacccatctcactctcaggggttatccctatatgaggggctacacaggaccctgaaaactaaaagaatggcccaaagtaacttcctgttggctgctgctgacaaatgattacaacagtacagtttttggaacaatatgtttggagccattaccaggtacccagagtccctaagaccatctacagactatttgtgatattactttgttcaaaggaagggatcattcttgtactctgttcagaggttccattaatgatacttaaatgcttctcaaaaaataaaccaagtggtagaagtcattttcttttgagcctgtttagaaatatcaatttattgtaaaaaatagaaaaaaaactttaatgatagttcttgaatcacataactttgtctatataaaacttatcttgcaaagcttcatataaagtttgagagaacaagagtgaaataatgggaatttacttcaacaaacaaaactcagcacccgtctaaatctctgagcaatcaaaattcattctaaggatattttagtgtttaacattatgttttacagagtaactggctctattctcaatgcctcaacttttttttaggctcagagagatagcataacttggatctaaaaaaatcacatagctagtaagcagtgaacccaggattcaaactctaggatttctagctcctggacttgtatcactactctaaatcaaatctctgcttatattatacatatacatgttatatatttatgtttaatgtttaaaaggctaatatatttctatcaattcaagtatcctcaagttgattacacataatagatcttaattacagatgtatgatgaaatttaccaaagcagggaattcaaatggagggaattcaaatggaaggaattcaaattgaaggacaagttaattatattaacactacaaataacaaatgctggagagggtgtgaagaaaagggagccctcctgcactgctggtgggaatgtaaattggtatagccactgtggaaaacagtatggaggttcttcataaaactaaatatagaactagcagtcccactcctgtgcatttatctagtaaaagctacaattaaaaaagatacctgcacctgtatgttcataattgcatgatttacagtagccaaatcatggaaacaacctgactaaccattaacagatgaatggattaagaagatggaatactacacatccatgaaagagaacagaataatgccatttgtagcaacatggatacaactagagattctcacattaagtgaagcaagtcagaagtagatagacaaataccatatggtatcatttatatatggaatctaaaatatggcacaaatgaacctatctgtggaacagaaacagactcacagacatggaaaacagacttgtgattgccaaggggaaggggagagagcgggaaggatggggagtttggggttacaaactattacatttagagtgggtaagcaatgaggacctactgtatatcacagggatctatatccaaccttttgggatttttatatatgtatgaccaggtcactttgctgtacagcagaaactggcacaacattgtaaatcaactacactttaattaaaaaacatttctcaaaatattaacagtaccatttatacatggttactatgggcaaaactctctcctacgcactttatatgcacttatccatcctgatcctaatcattccttgaaacaaactaggaaactgaggctcagagaagtgtaagtcacatgcacagtgtcagcagctataaaatgtggagcatggattgtgatgggaaaggtcaagatgatgactgttctgatttttccatactgaatacaagtattcaatttgtttagatttttccatattgaatacaagtaccagtttagatttttccatattgaatacaagtatacttcgcgacatatgttatgaaggagtttgtccattttacatttttggaaattgagccatagttacaatgtcttccagaaactcagtttaaaaagagaaagtataaacttatataaagtgaaaaattattttttaaaagtgcataattcctatatagcattcataaattagttcttaagctcataaacatgtttctttcaatttctttgtcttttttggcaatgttgtcatctgttcgtaaaagtttggagatcagctttttaaattgagaaatgtttgacataaaacattagtcctaggtgtaaaacacaataattcaatatttgtatgcagtgtgaaatcacccatactaaatctatttaccatctatcatcgtacatagttacaaattttttttcttgtgatgaggattttaagatatattttcttagcaactttcaaattctcagtatgtgttattaactgtagtcactatggaagatcagcttttaaaaataaatacttgaaaagactcttggtattttacagtagcaatagatcttcctcctccatgtttgttgcttagcaacacattatctgcactcaagtgagagctgacaggcttgaagcatgagtgagtgtgggggacagtgccaggaggagcattcatgcttcaaatgaaaatggagagaacaaaggattcaaaaatggggtttccaggcttaacatggattaagtaatatgagtaatacaacatgagtgatgcttaaaatgttgagaattaaaaataaaaattaatatggttaagacatttgcttttttattgttttggactctgtagctggaagggagccaagggacctagggtatttttgttagcccctctcccttttctccctattatactctcctttcctgtttggtttatttatccttttccttctttcattcaaccttttctttcattacctccttccttcccctcattccaaatttcctttctttaactgtgcataacacagattaggagttcaaaaaaatgtgtcattttttattgaaatggaatttatgtttatcttttcagttttaaaaaggagactttaagctttcatgttttacattcctactctacaaatgaaataaaactcaaaaaaacttttgtatgcttttaattgaacttgctttctcttattgaataataaaaccttgtcattaaatttcacatatgtggagttcccatcgtggtgcaatagttaacgaatccgactaggaaccatgaagttgcgggttcggtcccggcccttggtcagtgggttaatgatccggcgttgccatgagctgtggtgtaggtcgcagatgcggctcggatcccgcgttgctgtggctctggcgtaggccggaggctgcagctccaattcgacccctagcctgggaacctccatatgccgagggagcggcccaagaaatggcaaaaagacaaaaaaaaaatttcatatatgtacatacccatatgaccatcacacaaacaagatgtagaatatctccacatgagaatgttcacttgtgccccttctgggtaatatgcttttgaaaggtaactaagattctgacttctacttcttttcagcaaacattctactaagatttttattttgataatcattcctctaattgccaagaattttgatgtttttgattcccctctttttttagtggcccattctattctataatagattctcttgtcttctcaaatttctctggaaatactaattttaagttcgctattttcaatatttccttatgtttgctatttttttttctttcttctagagttaggagtttggtctgttcatcttagtccttcagttttatgtttggtaatttttgattaccaatttatcctcaattatctattactatttatgaatgaaagactatgttgctgttggccggggtttcctttgtctttatgtaagttggtttcccaaataaatcctctcttaaaagggagggatgactgaaagctctgtgtatgtgtctggtgtgttgtgaggctggcttcattttagaataaatgagctaggagaagagttcacctttccctaaactctaccctgcttccagctaaaatggaaatggacaccttagggtcttaaccataattaattcagagattaatttttgcttttagcctaaggataaattccactgcttcacacttgaatatagagggggaagtgggaactgtgagttacaacattgttagattgataagccttgagttagccaacttgttttctgacctgcaagtgccatgttctatgacttttctgctgggaagaaacatttctatgttcaaatattctcagatgaatgttgtaagctgtggcttctattctgatctcctcattagggaaatcccatcaactctattttattcagatttgtgaaaactctttagtgtctttcttttggttttcaatgatatcaggaaactattccctactgtacatctttgtgttcagtgcagtgggaatttggaagccagggggttttaaacacatgggacaagaccattgtcatgaactaaaagctgacattttttgactggaaagaaacatgagggaaaaataggtaataaataggggttaaaaatacatgaattcttgcatagataataaagttcagaataaatattttcatgtctattttaattgtaagaaatctgagataaaaggataatacctccactttttattttcagaggttaagtgccttctattaagagattaatagtaggtgggcaaaatagaacacggaagtatggacttgatgtgcgatattgtgatcttgctccgaagaagatgctgtcataataatattaataataagaaaggggagttactgttatgtctcagtggttaacgagcccaactaaagtccatgaggacgcaggtttgattcctggtcttgctgagtgggttaaggatctggcattgccatgagctgtggtgtaggttgcaggtcccagatgcagctcggagcccccattgctacggctgtggagtaggctagcagctaaatctctgattcaacctctggcctgggaacttccatatgccgcaggtgtggcccaaaagagacgaaagacgaaaaagaagaaatatggtaataatatttttcaaaatttaaattaagcagggaaagaataaatattgattgattctattaaatttagatcaaataaattttaggtacatctatttatttatttacttatttatttttgtcatttttagggccatactcatggcatatggaggtttcccaagctagtggtcaaatcagagctatagccactggcctacaccacagccatagcaatgccagatccaagctgtgtctgcaagtcacaccacagcttacagcaacactggatccttaacccactgagcaaggccagggatcaaacctgtgtccttatggatactagtcagattcttttccactgaccccgacagaaattcccaaattttaggtatatctttttaaagtatattttttggattaaaaagtattacatttttgggagttcccatcatggctcagaagaagcaaatctgacttgcattcatgaggatacaggtttgattcctggccttgctcagtgggttaaagatctggcattgccattatctgtgatgaaggttgcagacgtggcttgtatcttgcgttgctgtggttatgatgtgagctggcagctacagctctgattcaaccactatcctgggaacctccatgtgtgggtgtggctctaaaaagacacacacacacacacacacacacacacaaaagtatgacatttttattgtaaaaatttgaaaacaaaattataaagaaatcaataaaaaacccataatccttcaacagccttcattaaatatatagtatatttaatttcaggctttctttctatacattttaaaaattgagatgaatataaaggcatatttgattgtgtacgctatattatattatcctttttaaaatttttgtagtttattgaacagtctataaaggcactctttaaacaccactcagttactcattatgtgttcattattcaattaatgaaacactgactgttaagacttttggattgattacaacttttcagtattacaaaaacattgcagtaaatatcttcataagtgtttgaggatatctgagatgattgctttgggatatactcctagaagggaggttatttggcaataaatatgaatcatcacattgaaggcttttttatagattctgcaaaattaccctcaaaaaattttacacattgatttgacccctagcctgagaacctcagtatgccacaggtgcagccctaaagagcaaaataaataaataaataaataaataactgggaagaaaagagaagatgagcttgtaggggaataatgaaacttaggcgacatccgggaagattgtaccccccatagtactcagccaaggaggcactaggggagggacttgagtgctagagaatgtaattgcttgtcagggcactggtgtgcctgcctgcctgtttgaccccatgttgcaagaccgccattaaagtctcgcttggctgcacaaagaaaaaaaaaaacaaaacttacatgttatttttttccccatcatccagaaaggatgtggttttttcccctatctcctccaaaccggagaatggtaatggtaatggaatctgatctgagtctcttcaacttaacttttcaagatcccaatgttaaccaggtacttagtgtcttgttttagtttagcctgaggaaatgtcccctgtgtgtggtaccactgacatgaatcacctgacacccctgctatgttgcataacttcagtgacacagaaactgtatattgtcacttatatgtgaaatttgagatatggtgcaaatgaacctatctacaaaacagaagcagactcacagacacagagaacacacttgtggttgccaaggggaaaggggacgaagtgggggggaatgggagtttcaggttagtagacgcaaactattgtgtttggaatggataagcaatgaagtcctaccgtgtagcacagggaactacagtcttttgggatagagcatgatggaagataatataagaaaaaaaatatttatatatgtatgactgggtcactttgttgtacagtagaaattgacaaaacattgtaaatcacctataattaaaaaaaaaagacttaagaaactatattgagatgtgcacgaatagagactgagaggaagaaaaaggagggaaaaagagaacagaatttgaaagagtgtgactggtcatctgagtttatgacatctactcatctgaatttctatcaaatagttcttgaaagaggtgacgcctccatttgaatgtgagatgtacaaaaatactatttcttcagctatgtcctcactcaagagagaggcatgtgcaccctgaaagtcaattgagacaagtaacccctcctcgcttttatgatttccaagtgttgagggatctgctcagtttggtggcagctgcactcactgccttatttctcagattgatgtggtgcagtttccaaaaggctggtgactgctagaatcaggtcacctgattgtgaccacaggtttataaacgggaccaagcttggcctttgagtgctagaactaaacctttgcttttcctaaattgatcttagaccaaatcagtcctctctttaaacagagactgtagagatttccacagtgattggagttgagtatgtgcgtttgtttccattttcctaaacctcttttcttggctcaggacaattttcacagatttcatgattcaattagtgtttttatgatttttattgagatgtagcttatgtaccataaaaatcaccctttcaagggtaaattcagtggttttcagcatattcactgagttgtgcaatcactgctcttatctaattttagaacattttgtacccccccaccaagaaacttcatttccgttaaccccgtaatcattaacagtcactgctcgctatgcccagcctctgcaacaataatatagtttttgttcccaaggatatgcctattctgcatatttcatacaaacacagttattaaaatatgtggccttttgggtctcactacattcacaaggttttcagggttcatgttgtaacatgtatccatactttctttttattgtcatataatattccactttgtgaatatgccccaatttatcagttgatggacatttggattttttccagtttttacctaatgttgctatgaacatctgtgtacaagttttgggggggacatatgttttcacttctcttgagtatttaaccaaggggtgaaattgccgagtcatgattctttcatgagtcagtctatcctgcttttaaatgtgttcatgcaatgtccctcatctttcactacattctctaaaaagcaaccatctcaactttagtttgcatcaaaattatgtttcttcttaatagtttgaatttatagaaataatggcgtaaataatctcagtaaaatacttcaaaatctaggacacatcagcaaatatacaggcaattaactttccaaattttgttcaaaagcagtaatattagttgctgtggccaacagagtggactgaccttgttcttttttgtaagtgtaaaaattctataactgggagttcctgtcgtgtctcagtggttaaggaacctgactagtatccatgaggatgtgggtttgatccttggcttttctcagtgggttaaggatccggtgttgccatgagctatggtgtaggtcacagatgtggttcagatcctgagttgctgtggctgtggcataggcctgctccaattagacccctagtgcctgggaacctccaattgccccaggtgcggccctaaaaaaaaaaaaaaaattctgactctgaatccaaaggtagagacttgctcttatttccaaatatgccattgcatggctttcaacatattctttcccatgaaatgttgctatatatctacttcttataagaggcttttagttctccatttttggagaggctgctaaaagaatcctggaatttatgtcagaaatgtttgaaactttgtatttaatccaggggaactccccacttcttattacctattgtgccctctctcctatttctttatctctgtttctacaccaggatatttaaaaaaaaaaaaaaaaaaaaaaaagatgtgtgttatttcggctgattgtaatctcctttactagaggcacaccagatttgtctttgatttgtatttctttttaggacgtaagtgcatcaaagataaaaactgtgttttcttctactctcacagctctaaatgtcaaatgtagtaacatacccagattaagtatttggtaaaaacatttaaaaggaggatgtggagttcctgtcatggtacattggaaacgaatccaactaggaaccatgaggctgagggtttgatccctggcctcactaagtgggttaaagattcggtattgccgtgagctgtggtgtaggtcacagacatggcttggatcctgtattgctggggctgtggtgtaggctggcagctggagctcttattagacccctagcatgggaacctccacatgccacgggtgtggccctaaaaagcaaaaataaaataagtaaaaggaagatgtgttagcagattgaaaaagaaatgtagtgatacatgccatggcaaaaatcagactcaattgtgtgataaaccataaaaatcatttttcaggaaagctaaacttgctttataagtttttgtataattttacattgcaaaatgattgtttttctgtcaattttaaactggtttcatacctttttaaaaacatgtagatttctaataagggttattcttataactgtgactaaatagctcaggggaaaatccatccattttgctcaaaacacaattgaagttaattttgtttgacacaggaataggagaaatctgtaaaaaaatataattagtttcagcttcttttcactcctttttctgagtctatataacctacgttgtcactaccatgattcgccttttaatttttatatttcacctcagaaaataaaagagcagaccatggcttctttttgtttcttcttcctctgtatgtcatggtacttaatatacaatctttcaagctgttcacagggggttgacgttctgaaagtgtttgtcccaagtctcaggcagtcccagtgcccaagcactcattttcattttccaatggacgagttaggaagttcttttaactcagtcaaatagtaagtctgctgtttttttaaataagaaccattatttttatgctcttttatttaaaacactcctgtataataatatatagaaatttgaggttttttttcttgtaattttctgtcctgtagtttttgtaatattttgtacacagatgtaagctaattagggaagtcataatttttatgcttatcagaggggggtggggtttggtttgtttttttcctttttttttttttttttttggtctttttaggcccacacctgtggcatatggaggttcccaggctaggggtcgaatcagaactgtagccacttgccaatagccacagcaacatcagatctgagtcatatctgtgacctccaccacagcttacagcaatgctagatccttaacccactgagcaaggccagggatcaaacctgcatcctcatggatgctagtcagattcatttccactgagccatgatggaaactcctgtttttttttactttttaaattgaatctatcccaaacatttaccaaatttctttttatcttctttgttcttctcagtttcctaattgtttttaattcaaaatggagttttctttctaatttataaaggggtatgtatttatcataagaaaatctaagtgtgtaaaatagagtcaaacaatcaaacaatcttccaccacctattttacaaaaatgagtttcctccagggagagaaacagagggtgtcagacagaagaggatcaggtgaccagagaggctagaggagagcttgaagagtggtgctgtcagaagcaccatcatgaagatttttaagcaaggaaggttgggttgaattgcactaaaagtgaagagaggtgaatagtaaaaggaaatagtaatagtaaaaggaacagagatgaatagtaaaaggaatatctttcattaagttatcactttaagatctatgaaatgtttagttcaaatttttaaagctgtttagagagcctggaaaataagtcattcatggagtagtctgttaataagcatacattcaatgtgatgataattctgtggacacattacttcttgtagtgaaaaccaaaatctattttattattactactagtataattatttttaagtggctggcaaacacttaaggcttgatgtctttgtttctctttaggcctcttatgtaaggagctgaaagggaaataaaatatacaggatgaaaagatggcagcgttgcctcccccaggacctcagagcttcgtctacttcacaaaacaatctcttgccctcattgaacaacgcattgctgaaggaaaaacaaaggaacccaaagaagaaaagaaagatgatgaggaagaaggcccgaagccaagcagtgacttggaagctggcaaacagctccccttcatctatggggacatccccccaggcatggtgtctgagcccctggaggacctggacccctactatgcagacaaaaaagtgagtttatttgtgcctgcagtggtgcaatctctgtttgcccattgtacagaaagatggtgttaccgattgagattaaatggcatttaatgaaaaatcacaccatgacagaaatgtttggttaaccacatatgtaggatattccagagtatggttttttttttttttttgtatttttagggccacacttgtggcatatggaggttcccaggctaggggtctaattggagctatagctgctggcctacgccagagccacagcaatgccagatctgagccatgtctatgacctacaccacagctcacagcaatgccagatccttaatccactgagtgaggccaggaattgaaccggcaacctcatggttcctagtcggattcgcttccgctgagccacaatggaaactccaagaatatgtatctttttaaaattttttcatcgacactggttttggcattggcatacacttttgattttcttaatttagtagtgttcagtataatgttctgtctttttttttggagtcccgtcgtggcgcagtggttaacgaatccgactaggaaccatgaggtttcgggttcggtccctgcccttgctcagtgggttaacgatccggcgttgccatgagctgtggtgtaggtcgcagacgcggctcggatcctgcattgctgtggctctggtgtaggctggtggctacagctccgattcaacccctagcctgggaacctccatatgccacgggagcggcccaagaaaaggcaaaaagacaaaataataataataataataatgttctgtctttttggacatgccataaatgtgtacttgtagaaacaaaataattgtcaatctcagaagtaagatggggacatgttcagaatgcatttgcatggagatgacagctgaatccatgggaatatataaaatcactgaactaataatggggttttaaagggtactggatagaaaaagtttgagatggtcagaagtaagatgtaaatcataaaattttccgttattcaaaaaaaaaaggaaagagattacctcataaaattacccaagaagttgaggctagagtagggggactattgaaatgaacaaggaggatgaattggtaattttcagcacacagcctgtgttaggttttaacaggaatcaaagcaaaatagtggtggatagcagataaaaagagaaagtaggtggcagttgaagcatactaggaaatttgagaaatttcctccagaaagatggtcacttggggcaaggaataaatttaaaacctttcaaatgtagggtatatatagcatgtttgaaagtggagaaaaatttttctcagagagaaaaatggagagggttgagtaatgttgtaagaagttgcagatgttaacaggcaagggataagccacaggtcaggtttatctacattcaaaaagtggagagaagccttactgtgtgagcctttgactggcaaataggaggatacatttaagagtcctgatatgttgaagtaaacgtaggtacatctgatgaggaaatgcatgttaaatgatgtccatactttccatactgcaggagtggaaattgtccttggtgagtcagtcttgagagcagcagtgagaaagtgttgattgcattagggaaatgggagaaagtttgaaacaactgctataaaggttgttttactgagaaaataaggaggggattatgatcatttctgaggcagtagcagatacaagcagattgaacttgacaaagagatagtaaaggattagatcagtagcttccgtaacttcctccaacagtgctttgctgcttggcacctgcacacttagctttaagaagcccagaaagggaggataaagtccatttaaaaaaattattttgggagttcctgttatggctcagcaggttaagaactggcataatgtccccaagaatgcaggtttgatccctggcctcgatcagtgggttaaggatctggcattacaagctgcagtggaggttgcagatacagctcagatctggcattgctgtggctgtagtttaggctcccctgcaggtctgatttgacccttgccccagaaacttccatatgttgcaggtgcagccctagaaagaaaaaaaaaatattttgatttaaggtaaaaatagaagggaatatttcttgataagacagctagcaaataaagaacattgaaatgtcttgagaagtagtaaatgtgatgaagttaattttgatggtagaaacatcttcttcaggggtagttgctatgaataacaatacatgatattttgcttcaccttaaaaccagcatcttaacaagctgacagcacagcaagaaaaaacagaatatttgcaaagcctttgagaaatacgcaacattctaattaatcaatcagtattttaacacagaatgaaagaatgctaacatgtatccaggatctcaggcactagattttttatacaaattagcatgagtttaccacaatctggtgagataggaagtaataaatgatttaggactagcaaattttgtcctggtttttttggttcaaattgatttgacttcctactgagatattctgttgtacagctattctggagtttacttgtttttactctatagcaaccaccatgctcacaactttatgaaaatgaatgattatgaatgagtaaatagtgaaacagatgaaataaaaaatactttctcattttgcttattacttcagcctaaaaaaaatgcctgactctgcatgaatacctcctgtatttcccatttccaaaggtagcctggaggttacttgagcagccaccccttaagaagcaaaggagtgtttctggaataaatcccaagtcagaggtataaactaatactggctttaaatgacttgggaggtaaggaggaaatgtttgcatttgaatagaggattaactaatggaatcattttagctatgtgatagactcatttaatagagaatatttggggtgggactccagccatttgccttggccccagttcctttcaaatatgacaccaagcacattaaaagcctaataatgcacatctgcatcagtatacttgggtagagcttggtcaaacaaaataatctatttttaatgtacctctatttacatatggacaaataaccaaaggatcgagtctttatttatttatttatttaggtttggagctttaaattatcaactttttgtgccatgtcctagcctcttaatcattcttaattaaagtagttttgaggtccatttgcagcttcagggttgactccttaatgtttcaaattattcagactaattgacaagaatttagtttctgctacattataatcattgcttggattaaaaatcttactgattcctaatttgacctgggttcacattttaatttatatttgagtataatcatcaatgctttattttaaaaaggacacagtaggggttcctgttgtggcttagcggaaacaaatcagactagtatccataagaatgagggtttgatccctgaacagctcagtgaattaagaatctggcattgccaggagctgtgatgtaggtgacagacatggctcagatctgacattgctctggttgtggtataggctggtagccgtagctccagtttgacctctcacctgggaacttccatatgccgcatgtgcggcacttaaaaatgaatacatacataactaataaaataggacacaataaactaatgatagaagttaggacttcatttttatgaatgatgaatagattaagtgcttttgaatagttttacgcagtgtccttaagaaataataagttactaatcaccctctgctatgggtagtaagaggacaggtacactgtcttattatcctcacatccttgggtgccttatatgttgcctataatattagcagctactcacaccatttactaacaatttacaatgtaccaaccagaatttaaaagcttcacaggcactaagtgctagctctcaatttgtgaaatggtagctctggaatttagaatcctattggcccaacacgagagcttgtattctttaaataccataattctctaattttatgttcaataaattattaaataagtgagcaacataaaaatactttattcagaagttctcactgtggctcagcaggctgcaaacccgactagtatccatgaggatgcaggttcaatccctgatctttgctcagtaagttaaggatctggtgttgccatgagctgtggtgcaggtcacaggctcaactcagatgcacattgccgtggctatggtgtaagctggcagctgcagctctgatttgtccctagcctggaaacttctatatgccacaggaacggccctaaaaagaaaaaaaaaaaatctattcagatgttgacatctatgcatttgctggtaggattttagaatttgcttaactcattctgatacccaaaatttcataggcatacctatttttcccacctataattaactcctggatatgtctaaacccaggcaatcctaaagaattttcatttcagataaaatagggaatttaaatttaaaaatagcaaactaactcttttttttttaatttcaagtacaagataacttgatcttgccaagttggagcagcaatataattttcacattagctcagatgacctctggctcacaaagtcaccctgattattctgacagacatgaccctgctccctctttaccctcatgctctgaaaaccgtttgtatttctctgtgtgatacctttaacatcttgccttggattagagtttttattgcttttctaggaatctttttttttcttttgtctttttgccatttcttgggccactctcgcatatggaggttcccaggctaggggtcgaatcggagctgtagccactggcctacaccagagccacagcaactcgggatccgagccacatctgcaacctacaccacagctcacggcaacgccggatcattaacccactgagcaagggcagggatcgaacccgcaacctcatggttcctagctggatttgctaaccactgcgctacgacgggaactccggaatctttttgaatgcaaaactcaggccacatttcttttcagactcctttcattgccttttatgccatagttgctcactgcgcaattatagaaaataagagatgaatgagttttaaaaggcacagtaaactgagatttaagaaagcaatagttgtacttaaagacgaggtattttaaaactaattttcaatgtgaaagtgaactttctgttaaattatgtttatacataactggtatagtgaaagggaccaagaatattttttaaaagtacatctgaaaataatagattctgacttgttttcttgggagcagtgccatgaataaaaagcaagattacctgaagttacttctgcaatttggtgaaaagttttattaccagaaacccattcataaacttatgtaacttctcaatgacacaaggaatttgcttgccaactgcagaaaaatgagacacggacttgaaattggtctgatttccaagtcaattccttaggttgttttaatgttttgttgtttttgcttgtgttttaaatttttcaactaaatatcaaaaccagagagcgtcactcattatgcaatgattatgtaacatattttatgaatgtttgggtctattgatactattttttaaaattactgtggttagtagcaagcaagtcctttaatttgtattctcttgttttagctgttattagaattccacctaaaataggaaaactgaattgagtaataggattctttcaactctgatgttccttaaaatatatgaaaatatttttttgaaagaactcatgttttggaacatatgctactaaccatgacaatagccaacttgcagtaaaattctcaaagtaatatggtaacaatcagggatagctagtttctatttggtttgtatagaaggcagtgtaataaaagaccgaagttgtgttttaaactaatgccagtggccacaagttattgttactgatttgaatgttgaagggatatgaaaaagagaagacattgtattttgaaggctctgaataatacatgctcataaatggctcacttcttactttactgagaagaaatggacaatggacttgaagttcattggccaacatgatgtatggagctgtattaatggcttgaatctaatggaaatgtttcttcaatataacactactgaaaggagaggtaagctgcagatactaatgtactagattgtaattttggagtctcaatttcatactgtcttcttcttgctcccccagactttcatagtgttaaacaaagggaaaacaatcttccgtttcaatgctgcccctgctttgtacatgctttctcctttcagtcctctaagaagaatatctattaagattttagtacatgcatatcctttttaaaaggcttacttacaataattctttaaatgtagtttttgctaatttatttaaacaaattgtagtccttttgtacctgtaaagactctggtttatccatttcgatataacttggtgtagatctctgagtagacagagaatggcaattttggcatttgagggtaaactacttttatctattacttgcttgttcaaagagatttttttaaggcctttggacttatttagaattatcttgtagtgaaaaattgttagcatttcaacaaatgtcatagtcgaagttgccactgtggtcttttattatattccttgactctaagctaccttattcagcatgcttatcatgtgcactattctgacgaactgcatatttatgaccatgagtaaccctccagattggaccaagaatgtagagtaagtgggtataagtacatttcaatatagtcttagtatggttatttttatcttttcttttatatacatggatgttactgcacttataaaaactgtggtgtttatcttcccatgttatatagttgcttttctttcaattattttatttcctttacagcattaacctgctaatattagagtagaataatacatgctacagtcttttgtaaaaaaaaaaaaaaatgaccttatcagatccttgttcttaaacaagtcacctatctcttgtccttgggtatatttttgataggaacgatgtagggattttctaggcagacctaacacctgtattcttagtaatttttaaacacctctactttctgggagtatttctgatatacacattttaagattttctggaaatctttactatagtttattataatagaatgggtccatattaccagctttgattgaaaagaaaaaattatcaagatttacatggtaccatattattttcacacttaatatcacaatggatccttgtgtctaggtacacttttactggaatatatacttttgaatcacttgtaaaaattcttgcaagaggcttctgtataggagaattcactttccttcgtgacccgtggaactggcttgattttgtcgtcattgtttttgcgtaagtattttcagttttttgaaatgcctgattcatgaaaatctcagacagcacagtattgccgtaagaacagacctttggcatctgacttttcctgcatataatggatgcattaaaggatactctatgaaagctagtcatcaaaaaaaaaaaaatttttttttcggaaaaaaagcatttcccactcaaaaatgtatgacatcaagatagaaaatcttcctcacgctcagcacttagatgtatagtatatgcagtgccatttagatacatactttctccaagttcttatttaaaacttggtaagatccatgagaagcacaggaaaagctcaggcctttattataagtactctttttattaacctatattattcaaaagctaaaatatagaaggaaatcttttttaaaagtctgttgcagcatactaaatctaacattaatacattttgaatgcattatatatgcatccactgtttattttcaaaggaaaaaaatcacattaagatataattttaatttattcatattgctgctcttttcctaaatatatttgtccaaaatacttctttactttttaaatctcaaacctaaatacagtattttttccctatgtcattttgaatagtaaaagtaatacgggttcattggaggtatttagatagaccgtacagaagggtcttaagacccacctctgcatccatcaggctcactttttttgtggtcacatctgactgctgtggtcccacccaccactgctgctaagacaaaactgagccaaagaaggctctatcttttcagggatctcctatttattgagtataatttatgtaccataaaattacctttttaaagtataaaattcactgttttttcttatgttcacaaagttataaaaccatcaccattctctgattccagaatattttcatcatctcagaaagcagttacttccgtttgtcctcccctcagtccctggaaaccactcacctgtgttccatctctaagaatttgcctattttagatatttcatatgaatggatgtaatatgtggccttttgtatctggcttctttgaattagcataccattttcaagatttcctgctgccgttttatagaatattaaatacctaaattaccataatgttgaagtctggtaactgaagcattaagttgtttatttaggcatttaagcttatgaatccattttaataatatatttatattttgctcacatcaaatgaatcaaattaaattagtaatgatagaaacaaaagacttgcagaactatgactttaaataagaagttccaaacataagaagtaccttgactaaaggcacaggtaagtatcatagaatctatctaaattctgaataactctgatttaattctacaggtatttaacagaatttgtaaacctaggcaatgtttcagctcttcgaactttcagagtgttgagagctttgaaaactatttctgtaatcccaggtaagaagtaattggtgtgaagcactaggccactcataactccaactatttgggagttgtctttgtttgtttgtgtgtgtgttgtcactgtgtttgtgtataaactcccctattacagatatgtgacagagtttgtggaccttggcaatgtttcagcgttgagaacgttcagagttctccgagctttgaaaacaatttcagtcattccaggtgagagtggggttaaacactgaggctgactttgatcttctggaagaaaaacaagagaaacttgctcttatgcaattttaattaaatttgatctcttacatttttcacaatcattattaaaagtcagcctttgagtttaatcaattgcatgggtcttagaggatgaagatggccatttggttcacatctcaacttgaaattttccctcctgtctaacagttcattttccattttgcttatccaggaatgaaaatttcagtttgttttaattgcttttcctatagttaagaaaagagttataaaatatcagcatggggggatcgcatgacataatgattttttctttcctcaacaaaccatatcttaactgaaaattagtaagttgttactatatgctgtaattcagccttttttgttttgttttgtgttataagagatggtttgtttgatattcactgaattggaactttttaaaaattatctttatgagtgagtgtggatatggttggaacaaccaaattactcattttagcagtgtggttattctttggaaaattttccgtttttctatcatttgctgtaatatacagaaacaaagtatataaaacagcagtctccccttttgagctggtaggctcttgttgatttaggttatttaaggttcactgatttgataaaatgcatgcatttctaggaaagcttgtgttttgattttgtttctcattcagaggctttatttcattttgaacaccattttcccctctgtatgcaggcctgaagaccattgtgggggctctgatccagtctgtgaagaagctctctgatgtcatgatcctgactgtgttctgtttgagcgtctttgcactgattgggctgcagctgtttatgggcaacctgaagcacaaatgtgtgcggtcaccccttgaaactaatgaaacaatagaaagcatattgcttaaccttgatgaagaagagtataaaagtaagagtgccctgtgtttgttaataggttgttctcttttggcagtgaaatgttgctttcactttaataatttcagaattattcaaatagaacatttctgcagtgagtttggaacatgttatatttttgtaaatttccctggatctaagtttcctagcagttctaatattgagaacatgagatagttccataattctcaattgctgtaagataaaaaagaataaatttgttctagagaaataaatttagctatgaattaatgatagtaaccactacattttatcgtaagatatattttatgtatcttttattgtataattcataatttaatataatttactctataataatattttacttatttttataactacaacattgtacagtgatgttaatcatagtataattatactgttaattatcacatgttaacatgtctgtctcagtagtatttctaaagacttgtgtaagcagaagaatatactcagcattataggcattgtccttatgccaaatgagtgatgagtttcacagctctttctttttttttttttttccccttttttttttttttttttgtcttttgttgttgttgttgttgctatttcttgggccgctcccgcggcatatggaggttcccaggctaggggtcgaatcggagctgtagccaccggcctacaccagagccacagcaacacaggatccgagccgagtctgcaacctacaccacagctcacggcaacgccggatcgttaacccactgagcaagggcagggcccgaacccgcaacctcatggttcctagtcggattccttaaccactgcgccacgacgggaactcccacagctctttctaatggtgtcctttaatctagctattgaccatcaaaaggtttttttgtttgtttttttttttttttgtcttttgtctttttagggctgcactcacagcatatggagattcccaggctaggggtcaaatgggagctatagctgccagactacaccacagccatagcaacgctggatccaagccgtgtctgcgacttaacgccaaagctcacgacaactctggattcttaaccacctgagcaaggccagggatcgaacctgcttcctcatggatactagttgggttcttgaaccactgagccatgacgggaactcctatcttttttgtttgttgttgttttgttttgttttgtttgaaaagtttaattcgtcagaattaggtctataggtaccatttgagatgatctgtaaattaagtagatcaaaagtctacttaattcacaagtttattgtagagtatcttacagaaagcataaactgcatgttttataaacggttgtcccctaacagtttctcaaacagagctgatgagtttgggtgaggctgagatcacgcaagattctactttctgtctgacacctgcagtgggtctgtatgatgttgcccaatgaactcataaaccttaatagataattagatccagagatgaggtgggcatgtaggtacctttgatagaaggaaatcagggagtaagacaggattctcctctaatagtaaagagctgtatacatcagtttttattctttgtggtttttttttttttttttctactcactggagaatataaagacaaataaaacctagctaatatagtaaaagactataaagataactgaagaaaaatacaagcataaatcaagaaaacaagattaactgattcactttgctatatgcctaaaattaacacaactgtgtaagtcaattgtattccaatacaatgtttagaaaaagaaaacggaaggttttcaaggaaaatatttaatgcttattttttattactagtatttgatgaggaatttagcatattttcctttcctttttttctttacttactttttcagcttctggtttttgttaatacgatcttaaattttagttcaaatttccaaagaattttatattttcttgatttataagccaaaaaagtagtatatctcataagtaattgttgacattgaattgttctacaaattgttctacaacgcttacttaaatttgatgtttttatgcaaagatcactaccagacctttatttctgaatcctgagcgcattcttaagctcatgataggaatggtttttttcagccctgctggaattttacttcaagcaatttttttcaaaaagagtggaaaaatcccttgaattttgcagtatatcttcatattgtgtttacacaagagaatgacagcttaactaacaatgaaattttataccacaatcctcttgctctattctatacattattcttgattttcttctgaaatatagtttcacagtggagatgtttgtgttaagtctgagtttggtttcccacctgttttctgtgtcatagaagcctggtctcactgcggtatatatccaggcattcatttatcttatgtgtttattggttgcttccctgggctaagtaagcactgtgcagtttcctggagctgtagcaatgaacatgataacataaatccctgcttccacagagcctatcttctagggagaatgaaagagtaaaagaagaggaacagatacaagaatattacaagttacaacaaatactatgcaaagaaaataagtctcaggggctgagataccaactaaatgaaaagatccctctgaggaagtgacattttaacagagatctaaaggacaatgagcagccagtaaatagcatgagtgtctatgggggctgctgcttgacattgaaggaagagcatgtggaaaagccctgagacaagaaagagtatatgtgtttaaagaatgtgagaacacaagtgtggttagattttggcaaaggagatgcagaatggcagcagagaaagtaagagagaaaggcagggctcatatcatgaaggatatcctaacctgggaaagggagtttgggttttaatttaaatgcagtggtttttatcactttgccatatggagagctgattggacaagagtggttgctaaattggaataaggaagacagttaggatgttgtttctgtcatcaaaacaagagaagattgtggcttccttcacagtggtggcagaaagtgaaaagggtgagttcaagatgataccttagagttccctcgtggtgcaggaggttaaggattctggcattgtcactgcagcaactgtggtgtgggttcagtccctggcctgggaacttccacatgctgtggaagaagaaaaaaaagtgatacctatagaacttgctgagaggagaggagggcttggggatctcttctaggtttttggccgtaataactgaatagatggcaaggagaaatgaggaaaggtgggcaggtttgtaggagaaagctgctattaaccagtcaaaattgagatatcattgggacatccaggttgagatatcaagtagacaattggcaatttaagcacagagatcagaggaactgcctggtttagagatatacactttaaagtaaccagcacaagaaaagatatgtacccaaatacatacatccttctgaaaaagaaccctgattttgataagtaggtagagaatggacaacttggtgttttaagtagatttggtgtttagaggatgctgatcgccagaaccctaatgtctagaaggcagggaggaaggaggacccagaaaaagactcagagaaagagtggccagtacagtaagaagcagagatttaagtagtgaagccaagaaaagaaaatatattgagaaaagggagttcttgtgctgaatgatgctgcaagatcaaggattaagatcaagatcaaggatgaggaagatagagaaatatatattagcttaaataagcatggaaaccactaggggacttggatgaggaaattttagtggagtggtaggagcacaagattggactaaggtgatgacaggggcgactaagatgtcgaagagaagacagtatgcacagacaattctcctaagaaatttggctgtaaagggaatcaggggagttcccattgtagctcaggggtaatgaacctgtctagtatccatgatgatgagggtttgatccccggtttgatcgtgaaccatctaatccatgattccagatgggcaataataagaagggaattctcaacaccacaaaggcaatgagataggaaaggttttaggttagacaatcccctgagagctgataatagtacttcatgtctcagaacactgacctgacaataggcctcagtgggttaaggttccagctttgccatgagctgtggtgtaggctggcagctacagctctgatcaacccctagcctgggaacgtccatatgctgcacatgcagccttaaaaagaaaaaactaaaaactaacaaaaattattttttaaaaaagggaatcaataatagggatgatggctggcatttttttaaaaacatggattttgataggatgttagaaatgaatgagtaggaaaatacggagtgctaattcgggagagagggggcaggcaagcccttgagaaatcagagagacctctctgccatggaagcaggaggaaagatggaggagcaggctacagcctaatcaggataggattaagtccaacccagtggcttttatgtcctcagaaaagtgtgagatggaatcactggctgggagtccaaaggaggaattctctttgtattacattttccctttacatgttaaacttaaattctcttgaggcctaattatcctgataatttactggttacttgtttaggaattatattagagtgcttctcaagaccagagtgagttactcccattgctttacccttcatcattcatgtactgaggtaaatctgttatctgccttcccctctgacccccacatgccagcacaggtagctctagagcccatctagagatgattggtaaatgttaactggtattacctgaaaggataactctaacataatcttccataataaagccatcttggaggtttatgtgtaaaaatttgcatgataacctccccatcctcattctgccatgcacaatgaggcacaaatggtaccatgtaaggggaaaatgtgcttttatttcagttctatatcctcaacattcagaacttacaagccctgaataggtagatactggtgaataaacaaggagagaatttcagaaaacacgtttccttcatttatagtgttgccttgctgactgcctcttctggaatacttggagttttgcccagggatattttcattcccttcctcccttccccccttccctccccttcctatagcttgatgatgactcccatctttttatcttcatccttgatcccttcactaacctcaagactcataacaatccaatcacgtacttgataaatataaaacctacttactaatcatctctcttccacataccccatagggagaccatcagcaaatcctgcggcctttatcccatccccagctctctgtatccgtggctactctctgaatgtagccatgttacctctcattgtggtcacttagcttgtatcccttcttctacccctgccctcctatagtccacagtccacaaagcagcaagagcaacattttaaaatgttacttatcagctcatttctccacctcctacttcttttacttcctatcacttaaaatccaaactcctttccatggcatataaagccttgctccatggcccctgcctccctcagccaccacaattctcctcactcactgtgctgtaacacgtgctggccgtcttatttcttgcattcaccaattttatttctagctcagggttctttgccctttattcttcattctgtcaagacatctctttaccagatactttgaatggctggcttttttgtagcatttaggctctagttcaaatgtcagctctttagaaaaggtttccctgaccacatgtattgtattattttaatttgttttctttagggcatttatccctgtgtgaaaataccttgtttgtttacttatttttaagtgtctttctccatacccaatctcaacccttacctaaacataaaactctgtaaaactaatgatcttgtttatcatatttatcactgtattcactgcctggcccataagtgggtatcagtaaatactgagggaaaatatatgagaatataataaatgaatgcctattgcctgggactgggcctgaatgtggtgaatatgtcaattagctttttgctgtatcactcttaaagcttaccctccataatgttattttgttcattttcttcctaaacagaatatttgtattacttggagggatccaaagatgctctcctttgtggtttcagcacagattcagggtatgtaatatttgctttgattttcgtctaaaggctgaaaaaaaaaaaaaggaaaagcaaactcaatcaatttgctaaaagaaccttttcttctatattattttcatatatttcatgacattccttgactcattctgtcccacagtgagtcaagaatttaaaatgttcacagttaatgcatatttttgaaagcaagaccttgaggtagtgcttgaattaaaacaagaaacaagacacacaaatcttaagaaagcagaaaaaaaattgcttccagaaaactccaccaaagttggttcgatagtttccagacttctttctggaaaggagagtgacactgttagggagtagaaatccccaattgtattcattctccagtcaattatggttcataggttcctgaatgcagtgacattctggccactctaaacaaaagaatctcatggatactttgtcttaaagatatttcaagaatgtcatatttatgtcagtatctactctgctgtttctcccatacaccaacttcatttctgctgcagggcctttgttctttcattccctctgcccagaaatctcttgaccagtctctgtgtatgcactgggaacgtaaacataaacaagataaagttggtgctcccaaagacaccttagaacactgtttttacttgggatcatggatagcaatctacgaagtaaaaagaaaaaaagctttaaagctataaatctttatgaacttatatgattgctaaatattgactcttcttgattctaattctctccaagaataatttggggagatacagttttattagggggcctacatgtcaatctttatggatacaagaactattctgtgacatctggtgaaagtttccaagtttggatgattgatgatgatgatactaatagcagctaccatttattaaatgccttttatgtgtgggagctaggctatgtagtttccatacgttatcttctttaaacttaataaaaagtttaacctttgaaggtaggtgttattatcttgtctcacagcaagaaaaaaccgggtcttaggtaatttgagtaatttaacaaagtcaacaactagtaaaaagtaagggtagcattcaagccagttctttctgactccaaataatgtgttcttaatgattattcaacattgtccctctagaaaggaagccttgagtttcttatttctctgtagtactcttcagctcacaccctgaggatgctctgacatgtgatatcctttttcacatgtagtcagtgcccagaagggtacatctgcatgaaggttggcaggaaccctgattatggctacacgagcttcgataccttcagttgggccttcttagccttgtttcgactaatgacccaggattactgggaaaacctttaccaacaggtgagtgccaaaaaaaaaaaaaattcatcatattcactgcacaaaaatctgatgtatgctccttatcagctttatatacaagatgttttattcagttttgaatggagaaaacactattgtcttagtactaaaatctaacacgttctagttctagcactatgagaatgaatagtttttaagtcattaattactttcttatctgttctgggcttttttatctatagacctcttttcccctttctgaacatagcatttcatggggtcctaggtaaatagcaagaaatggactataatgttcacagcactcctacatacactatgctttctgcacatgcctctctgtttgcatgccctaaacaccaggctctcctgtgctcaccatcctttatttcatgagctcctgggtacaattgttctggactggataatatccccccaaattcatctgttgaagtcttaactcccagtaccttagaatgactgtatttggaattagggcctttaaagaaataattagttaaaatgaggctatttagggtgggcccctgatccaatctggtgtccttataagaagcaaacattagtacatgagagagagagatgcacacacgcagacacacacacacacacacacacacacacacacacacacacacacacacacggagagaatgccaagtgaggacttggtgagaaggtgaccatctacagccaaggagagaggccttgtggagaaccaacactttgattttgctccatcctctgggactgtgagaaaataaagttctgttttttaagctccccaactcatagcattttttttatggcagcctgaaaaacaagaattgaagactcaatttgtgtctgtaagttttcctctcccaactcagttgctccttcctttacacgtccatgccctatggctagtccccagtttacagtgtccatctcttgtcctgaaattcttctttcacatggccatctcccatctcctctaacttgcatgtgatcctctcgggactgggagctctatcttttcacctatgtattctcagcacccaaaggaaggagaccaaaaatgatgagtcatttttcttaaattgccacaggtgctacttttggcttgttttatgtttacttcatttctgagaatattataaatgaatataggaatggtataaaaatctaccacacgcaaaaaaaagaaatatgaatgactttttaagtatgaaaaaagatattcacctttactgtacattaaaactagaatgacataacttttcatctgtcagaatgacaaagatcaaaaagtagatcaggagttcctgctgtggcacaacggatgggcagtatatctgcagcgcgaagatgcaggttccatccccagcccagcacagtgggttaaaggaactggcattgccacagctgacacataaatcacaactgtgactcatatctgacccctggcccgggaactccatatgccacagggtggccaaaatagaaggaaaaaaaaagtagttcaaaagagaggcactgtcacactgaggtgtggggaagcagactctctcaccgattgctggaaaccactgggcagggtaacacaggaatttctctgaaaactaaaatgaatatacctgatgaactaagaatgccactactaagaatttatccaaaacaagacatcagtaacaacagtaactgatagaaaagggaactgagttcctaggcttcagagataggaaaaagagacatttttcatttcatatctgtttgtgctatttgaattttttagtgttaattaaacatacaagaaagattaatatttaccttaccttagcataatatactgttaatacttcttgttaaaggtagaattttatcagtagttgtgctatagaaataatctagttctatttatttgaaaatgagtaaagcagctagtttttgagcaattttcagactgggagaaaaaattcaagtcatgattatgcttaataatagtcaagaaacattcttcattttggtacaggtttaattgctgtattctatgtactgaaaaaagtgtgtattttaatactgattgttttccatgaaggtataattttattcctttatatttttgataacatgagattatatagaactctctgatttagcatgccaaatatgccattcaagttgaaatgatttaccaaaaagccgttctgtgttattaaaataaggatttccatttttcctagaccctgcgtgcagctgggaaaacctacatgatcttctttgttgtggtgattttcctgggctccttttatctaataaacttgatcctggctgtggttgctatggcctatgaagaacagaaccaggcaaacatcgaagaagctaggcagaaagaattagaatttcaacagatgttagagcgacttaagaaagagcaagaggaagctgaggtattgttatttggcttacaaatcttcctagaagtaggaatgtaaaggggaatgacagaagccctatgtctatactcagcctttcctggggtggttttcctccctgaattcttttataagaactgaatcttcattccgatgaggtggaaggaagcaattctggcttgagttaggtttgacatctggcccatttcaccttcccccataatcagctcactcactctggcatagagaacattctaagttcttccttctaaactgttacctatgattcctcagtgtatatacattatgcaaagtccccaaatatatatgatgtatttccccagaggaacaagtgtacacagatgtttagaggaaattattttgatgttaaagttaacagatactctgtagggtagacagcaaatgttcatgtgttttagttactgttgcaaggattaaatgtgagatgttgagaacacaatacttgtgattgtggccactttaggttaagtcacagattcttagatttctccttacttctccctccaaagggtacttcagtggaaaagtttaagaggatttgtactaagagaaccaacatttcaaatattctgcaagggtactaaaacatggttgatgatttgacctagttaaatctcttaaaggatactcacctattggtgggagggtggtaatctataatgcagaaaaaccttgatgcagaaagttgttcagtgcaggattttaataatattaaaaatcagaaagcatttaaatttccaaaaagtagaaaatgcttgagaggattataatatttttgtgtcttagagtactattcagccataaaatgatgtgttttaaaaatattatgacaggaaaaagtgttaatataacagtgtattaagttgtagaatacaaaataagatacaaacaatttaaaaattatacatataaagactggaagaaatgttaacaccagttatttctaggatatatgattatgaatgatttttggtttttattcacaatatctttatcttcccaatttttacaagcattgttttatttttataataaaagtttaatttttatacaacaggtagcagtaggctatcccaggaatttcccagggaacctcttaaaagcttctttcattttcttgagatattttgtaatactttattttattttcaaataattcattcctcattaaactatagaataacatgattctgttgataatatgtgttaattactcaaacaaggtatacaaattatctcatcatgtggtttatgagttttatgtcccaaaattacctagaataaaaactttcacatatactacttaaaattgcttacatatatgtataaattatatatataaattatatatatgtatatataatgtaatagtttaattccaaagcatcatatggctttattacaatgcaggagaagcagcaaatacatattttgtaaactctctagtcataatgcaaagaaaacaacattacttcctgtataagggacctgattacatgcagagtgtaattaaattcatggtaaatagatgccccataatagagtttcccagtctttggaagtgactcactgtgtgtgtgatcttttggtcccacaggcaatagcactggcagcagctgaatacacaagcattgggagaagccgaataatgggcctttcggagagttcttctgaaacgtccaagctgagctccaaaagtgctaaagaaagaagaaacagaaggaagaaaaagaatcaaaaaaagctctccagtggggaagaaaagggagatgatgagaaactgtccaaatcagaatcagaggagagcatcaggagaaaaagtttccaccttggtgttgaaggccacatgcgagctcgtgaaaagagattgtccacccctaaccaggtaccacggacactattgaatgcatgtcactggagattggattataaagcagattgttctatcttagggatgggacctcagagaggagtgactctatgtgtaaatttttaggtaaaaacttactgatttctgaacagttattcaaagaacataaatggacatgattttccatttaagtttgaccactctgagggaggttatagttttgaaattgtcacgtcttctccaacataaatattctaaaacaaatattcatgagaaccattgtagaaatggtaaaattatttatattataaattttatctttatttagtctgtattttgttttttttttggtttttttttgttttttttttttgttttttttttgtcttttgtcttttttttttttttttttgtctttttttttgttgttgctatctcttgggccgcttccatggcatatggaggttcccagctaggggttgctgtggctctggcctacaccagagccacagcaacgtgggatccgagccgcgtctgcaacctacaccacagctcacggcaacgccggatcgttaacccactgagcaagggcagggaccgaacccgcgacctcatggttcctagtcggattcgttaaccactgcgccacgacgggaactcctagtctgtattttgtaatgcctcattgtttaaaatgaaccttagactggtttttttttttttcttttcttcacccctgcaagtatcattagaatattagtcaccccgcctccaccccacaaatgcaccatctactgatatctagtcccattatcagttatgtgtgcttgtgtggaatttctctttccctcttcttctttttccattgaaacctccacctctctccatccctctgcctacagagctctaaaatgaaccattacttctatcctcctttacacttccctcttttccattgtacagtcccttcaaatcattttttctaaaacaaagtagttcttctgctcaacttcaaaacaaaacaaaagaaacaaacatctctgttgaatcactgcttgactgcagaacaggacccacattttatcgatgctttagcctcattcccaccttttttgatctttaggttccctcagtcccccatgattgtctaccctcacctacaggccctatattttcatgcctttattacttgggacacatggttttctctaagtggtgattttcttccttgttcttcttgtagcataagaccagtcattcttcacccgtgagttaagtgccacccatccatacactttcctctctcctctccactcctcccatcccctcttcagttactcactcagaattactattccttgcatctattttcacttaaaacgtctagcctctgttactcatgtctataagatcatgtctataagatcacgccagatatacacaaaaataagattccccgcctgcaaagatttcgtaatatacttggggagacagaatttgaatacatgtgatatcaataaaaagaaatgcaacaagagcagtttgagctagttttaaggctgagaccttatcatacacattttcagttgttcacaatgcccactactttgtcctttacataagcactaatgtttattcaaatagatacttttaaagaaaaggcagtttggtttatagacacagctcatcttggacatgagtcatgtaagcgtgaccttttattttataactataaaatcactagtattaaatggtctttcttaacaacccttaatgagccctcagtatgtagggtagagttgcaagcagtggaatgcaaagatgcatacagcatggtctttggcttgaagaaagtttcagtacatggaatgtaggaattgatatatgtaaagctcagtaacagttatcattgggagtttgggattcattgaggcaaactattatgtataggatggataaacaaaacaaagacctatataggaactatatagtacagggaactatattcaatatcctgtgatataccataaaggaaaagaatatggaaaagaatatatatatgtatgtgtaactgaatcactttgctgtacagcagaaattaacacagcattgtaactcaactatacttcagtaaatttttaaacattaatagttatcaataccaagttcttttttttttaattttatggccacacccacatcatatggaagttcccaggccagggattgaatctgagctgcagctttgacgtctgccacagctgcagcaacactggatccttcatccactacaccagattggggatcaaacccgtgactctgcagagacttaagccactatagtcagattcttaaaccactgcaccacagcaggaactcccctttttaaaaagtggtatgttctttataacaaaacgaatggtacagaaagaagggcgatatgactctaggccagaactgtgaagacttatacagcaacaagtaatatacctggtcctgaacggatgcattcttccagctttttcattccttatttagaagaatttgtcttcttgctgaatgtctttgtttttaaaaatgtttctcttaagctggtgccgagccacctgccctcaagtcagtgatctcaatggtagttacatgaaatgtacttctgtctttaggtttttcagcagatacatgtcatctctaattttttttgcagtcaccactcagcatccgtggctccttgttttctgcaaggcggagcagcagaacaagtctttttagtttcagaggtcgaggaaaagatattggatctgaaacagaatttgccgacgatgaacatagcattttcggagacaatgagagccgaaggggctcactgtttgtgccacatagacctcgggagcgacgcagcagtaacatcagtcaggccagtagatcccccccagtgctgccggtgaacgggaagatgcacagtgccgtcgactgcaatggtgtggtctccttggttgatggaccctcagctctcatgctccccaatggacagcttctgccagaggtgataatagataaggcaacttctgatgacagcgtaaggatgttttaaatagctcaggcatggttcggcccttattcttgcataagtcaatctctctgctgaaggggcctcctctctggtcctgggaatggctctgcattttgcaatactttatgttagaaacacatcttcaaaagattaacatctcctcatcctattggtatgggtgtctaattcaaagatatataaagccccatttttgaaaaaaaaaagtacttttctgttgatattgtacttaaagattataaatcattcccttaggaaacaacttgtaaaaaatgtactggcacagaaaatgaattgataatgccagtcttattagttggtaataggtcccatgtctgtaaggaaatatggattatttgtgccctactatttctttcaagtcagtacttaatatataccttattgcaagagatcatctttgagttgttaataatgaataatagtaataataatacaaacacattagttgtagcagccctatgagatactatattattatccctgttttacaactggggagactgaggcacagggaactaaagtgatttgtgtagggtcacttagctagtaaatggtagtcctaaagtttaaacggagaacttctgtttcagagcttgtgctgtttaaccaccacactttctctcccatgttggtaggtttctcaacttggaaataatttaaaataactatgcttttttcccatacataaatgaaatactgttttcatttaaaaacaactttttgttctagaatctatgaataaaaatagaatatccaaaacatatacattaatccaacatacacatatacagacaaaaacaaaacaccattccaaaccaataatttcgagagtttaggagactttgagaagttagagaaaatggtctgattaggcttgaaagtgagagatttctggtttccggagtttctcgactgcctcttcaggcctctcactgttttacactgcatcactcagtattagcaaggctttgcttaacccaagaagctctgaactcatgccacctattcatatattcatacttgcagaccgtgtagtatttcaagtgagattaaagttccgtcaaagccatggccacacacatatttccatttaaatagaatgcatgtgcttgtaggtaacgtatgacctctgtgcttgcgtgatacagcttcagccctctgtcaaggtatttttccttatcaaatgagcatgttaaatttccacagaaccacatctttgttgtgttttgcttttcaacaatgtgtattatctgtaaaagattatataatgtgtataatatttggagattattttcttatttttttccttttgctttttacctgtggcacatggaagttcccaggcagtacctgcagctcatggaagttcccaagctaggggtcgaatcggagctacagctgctggcctactccacagccacagtaacaccagatccaagccaagtctgtgacctacaccacagctcaggggaacgctggctcctcaatgcactgattgaggccagggattgaacccacattctcgtggatactagtcgggttcgttaccgctgagccacaacaggaactcctatttcctatttttaaatgaaatgtttcaattactgcttcatattttactacaaaaagaagttttgctctaaatcctaaaatttaaaatgaccaaacaggagtaatgagtggatacttaaagctttgacagaaatgcaaaacataacagtgtggaatatcgtacaatttagatgaaaaaaaaatgcatgacaaataataataaccctgactcctgagacatgtccacgtgaagactttatttaatcaacacagctgattgtttcacttgagagagaaaaatctctgcttctggaaaatcagtcaattagagaatatatcagagaaaatgtgattatagagagatctctatgaaaagctacttgcagatgtgtatgtatctttgcacatacacatacatgcatacatacatacacacatgcacatagttagactctttatggtttaatgtagacacatatataattatatctaaacaactatacaacgttgcaaccctagatctgtatatctctgtgtttgtaaaatggtatatgtgagtacacacataatacatactacacagaagtagatagatgtagagttgtatagttgtttacatgtatatatgtgtgtgtgagcatgtgtgtgtgtgtgtgtatgtgtaatgttggcctgcactgaactggcataatgttttaactttgaattagttgccaaaatttagcaactaatgaggcaccttcacataaaaatggtgtaccttgtaaaactgagctaatattcctgcatggcagcaatcctttagagctagggagtggtcacctcttttagatggagcttgtgatctccattttgctacagtttccatccgtcgtgattatccttttcaaactgagtcatttgtcctcatagactcagagcacttcatgagctcttccttagcagtgagaaacagtccttatagttgtctccattagtgctattaccttgacaaagaataattacagaaacttatcagagaacattgaggttctgtcccgttatgcacatgccactgcaatacttgtttagctgttctcttgtagaactcttacaaggtaaaactatctgaataaattagagacccagaaaaacagataatgatagtgattataacaatgataaaagctcattgcatttttcaattcctaagtattaattctcatagcaagactaagacaagtacttcagtcatccccaccttaccaatgatgaaaacagagacagagaagttaagtttctctcccatgatacacagccagtaagtagcagagccatgattcaaatcaacaatctggtctctacttttaattcctcactataactatgtgagcaagattttattttataccgacaatttattggaataccattcttaaaactgtactcaatcgtcttttttttttcagggtacaaccaatcaaatacgcaagaaaagacgtcccagttcttacctcctttctgaggatatgttgaatgatcccaatctcagacaaagggctatgagtcgggcaagcatattaacaaacactgttgaaggtacaggataatagtctctttaccatacaggtttttaacaaaatccatgtaagtcctggtctgccttaaataggtatagcaagttcttaggaagagttcaaagactaagaaatggttataagcaatggtaaggataagcagtggataccaatggaattgtctttatggacttaaaaagtggataaagttatttgtgattaaagacgggctttgggtaatataacctttcaaagataaaatagttttatggtgctaatgaagaaagtgaggttaacccagggttgtatggttttctccctatgtgttcttggaaactatacctagtctcatgaatttatcatctttctaataggcaagaaaacaagacaaacttccagatgtctataaattgctgcctttgagcacatctatacaaatggtactatgtaacatgacgtctcttaagattgtgatacaaaggcatccaagaaagcagtttagagactctgatgcaaatggtactggtcagaccctgagatacagtaagagcaaagtaaaaggatggcaatttagaaaatgtgttggctcccaccctctctccacacaatgtgccccaggtcccatcttgtccatgtcatccctccccatacccatgatgggtccaggcaaaatttcacccacctcttaaattcatggtgagaagcaaatgggctaatggtatataatatccattgcatgagtaactttgtaagttatttctagtctcttggttctgggatggtttttacttgtgaactaaaaagaacttttcctggtgagggtagaagtgtgttattgttgtaatgggttaaggacaaatggtactatgggtacaagggaaagtgtgtatatcgttggtatgtacacatttattttaaaaatatacatacctccattaagaaaacattagttcttttgtttaccatcatgtgttaagtgtatgtttctctcagagatatccatatctgctcccattcattaatttcactgccttctccttatggctgatctagtaaaggagcgtgtgatatatttttatgtaatatgctatgctttcatagaaacagtattgttgaattttcaaagtctaaaccagaagatttatttcagtattaaagtatactgttggtttgtgcctggttaggagtaaaatacatggtatacaagtgatggatttcatgttctctgtttttgtttttgttttttttttcctcccagaacttgaggaatccagacaaaaatgcccgccttggtggtacagatttgcacacacgttcttgatctggaattgctctccatattggataaaattcaaaaaacttatctattttattgtaatggatccttttgtagatcttgccattaccatttgcatagttttaaacacattgttcatggctatggaacatcaccccatgactgatgaattcaaaaatgtgctcactgtgggaaatttggtgagtccttaatatgtgttatgggcccagagctgctctctttggttgtcatgatggtcatttctttttttaattcagatgattatatagctaggaaactttgcatatacagaattcacgatatgaatcatacagagtcaagttgctggtgataggtactatttttaaataattttgtagtagtactgaggtctgtaaataacaatactatttctatgaggaatcaccatcttgggaagtgatgtgtgtttcttttcctgcctacatgtctcttagcagcaacactgaaaatttgatactttcttacccaatttataactacattgcagcttcctcatgagtacataccctacatgtttttagaaacactatgagctactttgttttgacataagaggtaaattatccaggtctttggattcccaaagtcctgagttggaattctggttctgtctcttattggttatgtgaccttgggaaaatgttttaatgtctataatctttaattttctcatttttataataataataatactttataaaataataacaattcttggagttcccttcgtggctcggtggtaatgaacctgactagaatccatgaagatgcgggttcaatccctggccgcagtcggttatccggcattgtcgagagctgtggtgtaggttgtaaacacggctctgaacctgtgttgctgtggctgtggtgtaggctggcagctttagctccatttcgacccctagcctgggaatttccatatgccatgggtgtggccctaaaatagcaaataataataataacaatttgttatttatgattctaacattttacgtattattgaaaagaataaacacctctacttaatagcctgacattttgtaagtactcaacaaattaaacctattatcattatcatgatcatcaccatgctttcaatgacagcagaaacaacccttgagaagaaaaacattgagaaaccaaagtggttaaactggatccagaagatagaagggttgtaggcttcaggaagatatagagttctattaggaaagttgatgccagagtgatctcttaaatgtgcagtgttgatcacctgctagcttaattagtgccttatggcaaacagaaagtgcttgtttctgacagtcttcatgaagcaagagaagttctatttcatagcgaaaagttcccagcttatgactcttcataaagcatgaataactctggatatctttgtaaatgtctatgtaagataactgtacatttgctgtggtcccaaaccaattgccctttgaagtcaaagagtgtttctaagtcagtcttctctcccaaatttcccagtcaagatgtttgaaattcaaatgtgaattagcattcttctttctattcctcagtggaagaaggcaggaccatctagtttctaactgttgatagaggtccaaatcatcaaaaccagtaccttctcactgaaatgactgtatcactctgaatccataaaaaagatttaccctgtttcttatctattattagaatcccaagtccagaggctcctggctagtccttttcttcttttcttttcctttttcttttcttttcttttctctgtttgtttaggaccacacctgcagcatatggaagttcccaggctagctcaaatcggagctgcagctgccagcctacaccacagccacagcaatgcagaatcccagccaagtctgtgacctacaccacagctcatggcaacgccagatcctgaacccgctgagtgaagccagggataaaacccacatcctcatggatacaggggatttgtaacctgctgagccacaacaggaactccttggctagtcttcttgatgctatattatttttaaaaatgatacacagttacggagctaaccattttcctttcgactttcttccatcagtttctttgaatcaaattgtacctgaatgattcctaagtcttttactgttgtccttttaagtgaattctttgttgctgtgtcatgaattaatgatgctttgtgatgcacttttgtgtcagagctttggaagtctttctttagctgccaccatttcaattaagaacttttcctcttctgctgataaatctttaaagagtgagtcaacatgttccttattactctgagtagtcagaccaggaaagaagactggctcaaaatttcaccatcaatctgtttcattttcctttccagccagaataatttgttgacccacataaatgttttggaaagagttactgtattaattttcaaaagttttatttatctgaaattttagtatgctcttctaaaatgctatctaatggtgttaaggtcggacaggagagttagagctttttaaccttatagtgcttgtattaaagctatgagagtaatgatacttggtttacaggattaaatgagataataatacacatatttaacacattttctgaaacgcagtaattgccagatagtcattatcatcattaggttggttccatatttttaataatactagaaaaacatttatgtgtcttacgtaggtctttactggcatctttgcagctgaaatggtgttaaaactaattgccatggatccatatgagtattttcaagtaggatggaatatatttgacagccttattgtgaccttaagcttagtggaacttttcctagcggatgtggaaggattgtcagttctacgatcattcagactggtaaatgagaccaaccttaccattatattctttatgtaaaggggtgtttctttggttttgcattattattatttaaaacttttggaagtttgaatcaaaagacaagagtaggtcttgatatctagtgaaacaaagttcattgagtaataaatgtacttaaagaaccacaaatcagatggatattttaatttgaggatcttgaagatgttcagttgtatatactagtattatagggcagtaatttatttcacaataagaaatgtatgatttatggaatttcagccactgtactatgttcattactttgtggatttgacaattaaaaatcaagtcattgtcctctcaaaatttttatctgatatcaaaaaatttttttaaaaatgaagtttttaaatgcatcatcctctaagattttgggccttctccctatatcagcatgaaaaatattaggacagtaccataaaatagaattaaggatatattttgacttctagaggatatactatctaataccataagaggcttctatagcaaccctgaactaagattacagttgcttcaaaatatgtgtggtaattacatagtggcaagtatacaagtataacaaaaataaccagaatattgagaataggtgaaaataagaaatagaaataattgattttagctaggtaatagtgaaagtattttagaactaaattttggaacaaaattcaagattggaaacattgagaactttttcataaaaattaatattaagctttgtgtttacttttagctccgagttttcaagttggcaaaatcttggccaacactgaacatgctgataaagatcattggcaattctgtgggggctctaggtaacctgaccttggtgttggccatcattgtcttcatctttgctgtggtcggcatgcagctctttggcaagagctacaaagaatgtgtctgcaagatcaatgaagactgtacactcccacgctggcacatgaatgacttcttccactccttcctgattgtgttccgggtgctgtgtggagagtggatagagaccatgtgggactgcatggaggtcgctggtcaggccatgtgccttattgtttacatgatggtcatggtcattggaaacctggtggtatgtaaccagatgttcctacacttgaaattctccatggcaaattgttatatgattatatgatatataattataatctttataggattaattagatttaaaactattaagtataatagaatattgactattttaattcagtgaaggacagaaaataaaatgaaatgctgccttaatctctgtgtcagataactgatatttgcattttttacaatatttcattggaaaattttctactttattctaatttcaatagtgatgtcatatgaattaaagtggttttcaagtccattaaacgttgattcaaatatgaagctatactagtaaatagaatataattgaactaacagtaataaaagtgagattatatggaagaaggcaaatgaaaagactagtcctgctctgttatagtaatatatgagactagcatctgtaacggatatcagcaactatatggcccatagaccaatctagcacaccactcagttttgtatggctctgcaaaactgagatttttttttttacatctttaaatgtttttttaaatctatagaaaaatatttttttggcacatggaaattatatgaaattcaaatttcagtttccataagcaaaatgtattgcaacatgttcatttacatattgtctttggctgtttcacttcacgtgggcaggtctgagtaggctccatagagattctgtgtcctacaaaggttaaattattattatatggcccttttacagaaaaggtgtgcccatttctgctctacagtgtctcttttataagtgagctactgctccattagtgttttcttggcttgtatgccttctctgtttgtgtcctcctttcttattatacttacctactggtaggaattttcaagcttacaagtaggagaaaatacggataatatgctcttactcagtctttaaaggcaccatgttggcttggttgagttggtcagcctggcctcagactcctcaagtatccccaggaggttgtctatggtaaaagtcatatggttagtacttcacttcccactggcttgaaataagttgctttttttttttttgatccttgcagcccccattccaacctgaaaattgctaaaagtatagacttaaatattctccccacaaaaaaataatggtacttctgagatatgatgggagaattccctaatgctatcatgacaatcatctttcaatcagttcagtctaattgcaattttttaactatgaggtagatgtttttgtccataaggagacttacatgaaagggtatttcagttatcttgttgttttctatataaaacattttttaaaatatgatttatgtatatttagctctctgaggattcttttttctttttctttttttttcaatgttcagttcacctggacccctacctctaggaggaaaaacaaaaatggttttgcatacaaacaggattttgcttcaaggatagaataggagttgtcctgccctcttttataatctcttccagggccaaaatgattggcaatgaagcaacccagtcataatgccattatctcatttaaatcagatttgatgggcaggtctttttctttgctttaaaagcctcattacatcacaagctggcacaatgtttggtcagaatatttcattacagtaactctgcaagtatcatatgttccatttgttgcaataagtgacatttatctcctgggaaaagtaaacacagatcttggctgaggttacctgcagcacagtagacactggtaacaattttcttgttttactaatttctcataggtaacaaatattaactacaggtaaatggtaggagggctttttaagcccataaaagggaatttggacaagggattcctgccatagaaatgaacttaggaatggcatcatgataatggtgaggggtattcgccttgctccccatgttaaccctttaggggcatggctgacctctatcaccaaagctcacagaagctcagatatggagagatttgatgagaagtctagcttctcctctaccccatcatgtttttattgggttaagaagtacagggctcttcatcactggtttagattttggcctttatctcagaaaactgcactcattttcttttatttcctgtctccctatttctccaaacactatccccaccctgatacaggttctcaacctatttctcgccttattactgagctcatttagttcagacaatcttacagccattgacgaagacactgatgcaaacaatctccagatcgcagtgaccagaattaagaaaggaataaattatgtgaaacagaccttacgtgaatttattctaaaagcattttccaaaaagcctgagatttccaaagagataagacgagcagaagatctcaattataagagagaaaactatatctctaaccgcacacttgctgaaatgagcaaggatcacaatttccacaaagaaaaagataaaaccagtggtttggggaacagtgtggacaaatacttgatggaagaaagtgattgtcaatcatttattcacaatcccagcctcacagtgacagtgccaattgcacctggggaatctgatttggaaattatgaatactgaggaacttagcagtgattcagatagtgaatacagcaaaggggtaagattgttttatacacattgtgtttcatgttattaattagtgtaaaatgagttacaattgcagatttttgctgtcataattgtgtgtgtatgaattcttacagtagcttcttaaagttgacaggggaagagatgttcttaatcattgatttaatcccatttagctagatttgaaagcaccgcatacctgagtcttcccttccttcatccgctgtttgttatcagctacaaaatcacataccgtctcttttcacagtgtcttttgaatcctcagctcctctccatcactttgcctttgtactctctactccttgcctaagccattccgtgtggagtccccacttgtgtctctgcctccattttccatatgctctaatccacctttttgattaattttactcagattcagtcctaatcatgtcactcctttgaagtatccttgagccccaaagtggatttgaatgatggactgtagataaagccttcacaccatggccccagccagctgaccagctttgtcatctagtactcacctgaactcctgcatctgaaccaagccacgtttattctgggccatgaacacttagaacctgtatgatgttgcttggggtttccttcttcagtcaaaatcttctacacatttttcaagacagccctcggcttccttggatgtaaaaattattagttcttacatcatagggctcggtgagggttaaatgaattaatacatgtaggacacttagaacagtattcagagtgatcaaaagtggtagctattacatccttcctaatttctcttcaaagcgatatgatctcattttgaacctcacacaattttacaccttttcctggatttattttttagctttgaattttaattttttgagaaattattgtatgcatcaaattgtactataaattcattgagaatgggaacctttttttttttttttttttttttggtctcacctgcaacaattggaagttcccaggccagagacagaacccacaccatggcagctgatacagtgacaactgtggatccttgacccattggatccttaaccctctgcaccacaagggaattccgacaaaaggaaccttttattacaacgttttttgtatcctcttcccccacccctgattgtgtatattcaaagtattattgagcatatttttattaatatggaatataaaaccataagttttatgacagtatttttatggcatctcttttaagttttaagatatcactttcaaatatttttcctttctttaggtcaggtcacatgaaagtatttgacaagtatttcccaaacatattctatctgcttaaccctgtattaagatctatcctccctatcctccatgaagctatagtggatttgtggataagggtacacagctgggcatgtgtgtttatgtatgcatgcatgctctggccatgtgcccactactaggtgcatagtgaatgctcaataacttaataactgaatgaatagattattaaataaattatgaatatatatttctaagtagccaaagaaattatttctgagatgataaagtaaggaataaaatattttagtttttatttttaaaagctttacacggaagaaatattatctccaaaattcaaaaggtgtggtggtttgggcatgaaggtagatagttagattccacataccctgttcaggagcacctgggtctagttttatgggaaaagggaaatgaattcaattatcttatttttctgcctacaaaggttagagttataaaaccctggttgcctagccgactgtctgtataagtttgagattctagacgttagggtactttggcagcttggcagagtttacgaaacattgcttacatcttaatattttggaataatcatttcttacctggtcacttttctttgctcaaaactgtggctatccatccatggatctctttagtgtctggccaaagtcatcttcttagtatattgagttataacattttaaaggaaatctcatagatctgctccctttagcacctcattttctgagaaagtagtaagaggaagtatctttatttggtatagagctagttcaaggcagagcccaggtaagagtcccagttttattattcatgagtcgaccttccttcccctgtatttgtccataaaccacacattcctatttggattaatacacagtttgtctcccctgaggtaccgaggcttcatttgataaatttatataccctgtggtatccagaggaggtttgtgatgttgtaatacaaagctgtcttttataattagcagtttagtctgtaaagtgtttgggtactaaaatagattattttgatcatccataaagttactctgtcacctatttcataaatacttcctaaaaagcatgaaatttagtgcatttaaactgtgttatctaaagaccatgtgatggtcatatttgcatattcttcattatcattggattttttatgatattatattcagagctacatgagaaatacactttttctatttcacatctgtgatttacatagtattcaggagcttgaggctattcataggttgtcataaagaatatagaaactagtcatttaaaatcatttaacatagtatttgagttggtaagtcctaaaacatgttagctattgtgtttattattgaattcattactagtctctaaaagttcagatttaaaattttgaactttggaaatttgtcttttttcctaagacattttccttggcatatcgcaaagtgtgtcatcttgaagcagactacttgactatatgccacacttgagaagcgatgaaagttcaagatctataggaaatttgttagataatgtagagatactattaggctgtggccaatggtgaaatcctgcatctagaatctttctctcaagtgacctgagatttaaatatttctggttatgccctgttagtgtttttcaatttagaccactaaaaaaatgcagctttccctttttgcctgaagtgtttctattacccttccctgacaacctctgtgctctaattcccctcatcttcaactcccacttgagttcccagttttttaactgcttcttccctcctttataacttccttatttttttatgcctaagacatctttgaaataatgactgccatgtttttggtgaacgttgcccaaagaggcaaaactagattatccatagaaagtgatgcccaattcactacatgtacattgttaaatcttaagcactaccttaagaatgtggtaaaggatacagcctctggagagagaataacttgccttagatccttgctttgatatttactaactctgagaccttgagcaatttacaaaaacttctgggtttttttttttcctagtttacttacatgcacaatagaattataataaatattaaatgatttaggtaaataattagacaagtgcctgttggaaacgaagtacctagttaacaattgttatggatatggaattgaatagtcctgtacacattgtaagtagctaagtgctacaggttcaattttagcatgtaaagacacatatagggaacttgttacaaatgcccattctgggccatatcatacaaactctatctgcctaagtctggatgcaacctcagaatccttaccagcaatagccactgagatagattgagttggtataagagataaacctaaattcacccatggcttgttttggtccatctttctgaagaattcctttctttattcaggggccagggatatttttcccttttgcctatttaagaatctgcattttgaacaagagggaaaaaaaatcttctacctttgacacttttctctttccccttccccatccaaaaaacaaatatcccctctctttcatggtgtagcctcatttttttccatagtattttatgggactttctgtcctcttccagtatcagctgataggcagatgtcttttttctgatggctaaataaatatacactccagaataaactcaaatatttcgtaataaaatatctgaccagaaaatgaccaaggaaatgagttctatttaagatgttgaataaaatatcttcaacagttttgaagcaataattagcaacagaatgtcagcatttctctgaagatagagtctgtcccagagtcaaggaagacatgctgtcatcttgggggacccatgagaatatgactcctgtcactgtttctcaggttatgctctgaactgatggcccatctcagaatcagcctccttccagggcatagtgcagcctgctaaacccttggcaaacattaacaagctacagattttcaccattagcaatgaagcgcttcattattatgagcctcaaatgaagcatgaaatgcacccattcattcaataaatatttattgaaatctgctatgctccaagcactgtgctaacagttgcttagagaccaaaaaaaaaaaaaaaaattttcacccagctgtaataattcaatgtgactggcatctggcttaattaaattcttaagtgtaagtctttattttttaatcctgccaaatctcaaaattgtaagttctaaaaagctaaattaataaatctttgtttaggacttcctgtcgtgactcagtggaaatgaacccaagttgtatccatgaggatgcagttttgatttctggcctagcttggtgcattaaggatccaacactgctgcaacctgtggtgtagattgcagatgaggcttggatctggagtttgctgtggctgtggggtaggctggcagctgcagctcagatttgacccctagcctgggaacttacatatgccacaggtggccctaaaaaaaaaattttttttaaacttagtttaaacggggagctctttcatagagagactttcccttttttcagttatttactaattttgaaagtattatgtaaatttcagggggaaagtattgaatttatcctgctcatttctccaaatattttgaaatataagcctcgtgtgatttctttcttttttttttttccttttttttcttttttcggctgtgctcatggccatgtgcagttaacctggccagggatcaagcctgagctttagcaatgacggaagccgctgcattgacattgctcacgtgattttggagtaaactctgacagctttcacagaggctactaactattaatctaatagtccaaatcttcttactgctcttttgacaaatgtatcttttatcagtgaacttgctcatcttgtgtactcagcagaggggaaaacatcctgtctaaacttttcctcacagaaagatcccccattcattcctcctgcagccaaatgcagatacttagctttactcagtagttcttgagtgtttagaaacattgtctccaagttgtgatggagctagctgaggcccttggagaaaggagatcaatgaaaccttcaaattttacagaaacttccacctttcaagagagtgtcacttaaaactgcaaacacagttatacaaagtatatgttcctaaaggaagcaaagtccctatacacttctcattccctgtcatcattgtagaagaaaaaaatggcaaaggaattgatgggggtatatagtctataaactgtggctattcattttttcaactcacatttcctaagtgcctgcttgttgctttatgagagcatgccaccagtgctctcatttcctcagcagatgtaggctgggtcttcttggctgttagcactgtctgaagtgataaaaagtaaaaacaaagttgctgcctttgaagagaaacacatggaaaccagaaattataattacacatataaaaaataattaaaacagatttttagaaagaaatattgaggctggataaggataggtgactaatcttgaaagtaaattggaatacttcagagtggaggtggcatttgaagtgggttttatggtagaaagaatttattaggagaaagaagaggggaggaaagagtgaaagggagggagcagggagagaggtgacgagaaggggacgcaagatgattaggcagagggagaagctgaaatgctctgcaattgcagcagaggccttggctgatcctccaggcatctctggcactagaatgaccctttggagtagtcccaaactgaagcaaggggtcaggactttgtgtacctcgtgctagtcagtcattggatacaggctctttgtctactgtttcagtggcggggatgtcaccttgggtggggtagctcccttctgcatttcaactcccagagagtcgtgagctacaggtgccaacactcatagcaggtggaggaatgagtggcttgtctgaaagggaaatctaggcagtacacctgagggtccactctattcaagggaccctagaaagagggcaagtgattaactcaacacttgagaagtggatacaaaagaggaagacaccaaagagaccaaggagaaaatgcatacattagccacttacatatacactgtataactttcctccttacggcaacccgggaaagtagataatatcaatcgacatttacagaactaagatgctaaaagattgagaaatggtgctggttagttactgatgtttctgggggtcttttaaaatttgaactccaaactttaaccacaataatgcataccatagaaaggaaagagaatgattaggaatataattattttctgttatttctctgtcatgttgcaattaaggatcagattttctgttataatggcattgtacatttgctatttcatgttcagtttctaatcctacttagtgctaattcattaggttatggtctacctcgatgatataatagataacagaacatagcacattccataagagaaaaataaaccaatccattgaggatgcattcagtaagggattatatcaggttgaaggcacttgttaggaggtggcacctaagctacactctaaaggatggagatcatttcactgtgtgaatgtggtgaaggaaatctcaggcagaggaacaaacattcatgttgttcatctgaggtactcattcatttaatccatccacccattcatttattcagtattcagtttttgaaagccatcatctttggagcaacttaaatgtgcttacttgttattaagtgtattccctttattgatttgataaaaacttgttcaaatatttgcagtcatcatggttaaatattttatggatttttactatatggtagttttaattacactccttagatttttttttaatttttttgcacaaaaaagaattgtaggcagtttagatttcttctcattattgcatttttaaaaatatcttttccagaaaggtatttgatttggcaagatttagggattaattacaattacacattttggggaagctgatatttgatcctatcttttatgcatggattcttacaaaaacaacaacaacaaaaaaaaaacaaaacaaacccctatagaattttactatgatcatttcttttttttgcacatttgtcccaaactatttgaagaaatgttcattcttattggatttgttcatatgtctaaaaacaatgaaattttggtcatttaaatcagtgtttctgaacttttgcattttgatagatttgaaaatattcctttcctataatgatgtttgaaatgtgaaaattaaaagtaaatcaggagaatttactgatgtggtacaaagggattggcagcatcttgggggaactgggatgcaggttcaatccctggccctgcacagtgggttaagaatccagcgttccctggcttaggttgctactatggctcgaatctgatccctggtcggggaactccatatgctgtgaggcggccaaaaaaaatggaaaaaagtaaaaagggtaaatcaagaaatgctcactttagaatatgcttcaaaaaccacataccctcactcttaccccactttaatattgaggatcacttattttaaaatgcttgccatgtagagcaaacaatgcaaaagattgccttcccacattgtagtatttaaattcatctcctaaataacagaattttataactgtttagttcattatttttaaatctatgttgaatgatatttaatcttattactgtttcaaatatattgttttgcattgagcatatagcatgtattgtcaaaggtaactaatttctacttacaggtatgtggctttaaatatttttaatcaattgaataaactgttccatcatgctgcatttacagacttcagttcctaaccttcttacttctcacaggggtaaaaacaaactggatccatcaaggatgcaactctgtgcttttaaccaggcagagacatatatgaccacttttatacaggttacctaaaaaaaaaaatcatacatatgtatatgatattttttttcagtgtcgtgcatgctgttcagctacaaaatcgttctgcctgacgcattgcaagaaagtagaaacatacacagttgttccatagatgaattgacatcacagcatgtcactggggcaattccatctttttttgttattctcttgatgacttccttgatatatctctcatgtccttgggtgattttaagtgcatgatctatagattttttttttggatagattataaaagtaagatatagtatgtaaacagaagccattaaagcagcatttaatttaaagacctctatcaaattcctgtcctaatttaaggtatacagttgacccttggacaacagggatttgaactatgtgagtccacttacagagagattattttcaatggcaaataatatagtactacacgatccacagttggttgaatccacaaatgtggatcaaaggatactgaggaaccatggtgcagagggctgactataagtgatactgaaatgtatactgcacaaggagtcctgcctctcagccccatgacattcaaagatcaactgtatgtttagttgtatatcacattaaatggttaatgtttacaatgaccagagtagagttttaatattctcaccaccacaacaacaaaatagtaattattgtgaggtgaaggaagtgttaactaacctgactgaggtaaacatttcacagtatatgcatgtatctaattatcacatcgtataccttaaacttatacaatactgaatgtccattatatctcagtaaagctgggaaaaaaacaaatattgtcacattcaaattcagtaaatgaaaactattaggaaacaattttgtgggagaaatatttcaggcataaacataaaaatctcgtactaggaaagaccattctagcgctagtcccatattcacagataaggtaattgagactcagacagtttctgagtacatgtctaggaagttggagacagagctacagtacccagcttcaaggccaaactctgaatatactttgaagtgatcttaagcacattcataactagggttttttctttaaatcaacaattaatgttagttttttatttgatcatatacaaaatgcattaattaataatttactaggctctgcctataaaggaatgttataaatggctgaagtgattaatttggttccagaagcagttttacatacttatgagaataagtttcttattatttacacttggccctccgcatccatgggttccacatgagcagatagaaccaaccggggatcaaaaatattaggggaaaaaaaaatccagaaagttccaaaaagcaaagcatgagtttgcggcacaccagaaactacttacatagcatttactttgtatttacaactacgtgcatagcatttacgttgtactaggtattataaataatctatagattatttaaagtataagggagaatgaaagaatgtgcataggctatatgaaaatactgtacctttttatataagagacttgaggatttgcagattttggtatctgctgaggtcctggtccaacctcccaagatactgagggacaattgtatatatcttatgagaggacagatgtacaaagtagtctcaagaagatgaggtttaaatggaacatattatgaagtgaacactacatctggagtttctgttgtgacccagtggactaagtacctgacatagtgttcatgaggatgggattcaatccctggctttactcagtgggttaagaattttgtgtcactgcaagctatggcataggtctcagatgcggctcagatctggcattgctgtggctgtggcgtaggccagcagctgcagcttcaattcaacccctagcctggagattctgtatgccccaagtgcggccacaaaaaaacgaaacactaaatctgtcaataagatataaaacactttctctaaaattagaaacaggtcaacatggattgccatatctaaatgtctaacacatataaaagaaaatatactactcagatataatattttatttttagtatagcctgttgaatgactaaactctagtagttccttggaaggaaaaaaaatctgtgttaatctgaatgttggctttttatatgtaatgaagttcgtattttaaatttgtctttgttaggatgtttgtattattgttttccatttgcaatgatgaaagcaaaactgtatcctgaaattgatacactctgggaatagtaatgctaagagtttcaaattttttttaaatatcattcttctagtttactcgaagttaattttaaaggtactcttaagtaaaagacatatttttctatttcaaattgatagtgatttagagggagtatttccttagaaaacaattttattcaaaaatgtagtaaatttcctttccctagaagctaaagtaagatgcacacgtatacagtagtatctatatatgtgtaggtaaaacattgtttttcagaaaactgttttcggaaatatgtgtgtatgtgtgttattgtgtgtgttttgtgtttgtgtgtgttttgtgtttgtgtgtgttttgtgtttgtgtgtgtgtgtgtgcttaattcctaagttattattccttttttttttttttttaaccaaactactgctagaaagcatgaggtgcatattaaggaatggtcattcgcctgataaacaaaaactctggatatttcagttgtaaggaataacttgcaacacaatacttttcttcggcagaagcttcctacataaaggttaggaaaaatacattttatctgtgccaaattttattttgcattgtgtttgcaatagaaaaagtccaggtatttaaagcctgctaactgttccactcattggaatttgtcttttcttttccttcctcgttgtgggtagtttttagggagtaacattaatcattcagatatacagcttgtttggtttttgttagtcatttcttttttagttataaataatatttagtgatattgggtcacaaagtgtatgcttttacctcacattttgctgtcatgtttacctatcttccaatccttgtttacctccttgctgcagttgtctagcaggccttagcagtaaaaatagtagtagtatggagttccctttgtgatgcagcagaaatgaatctgacgaggaaccatgaggttgcagatttgatccctggcctcactcagtgggttaagaatccggtgttgccgggagctgtggtgtaggttgcagacgcagcacggatctggcattactgtggctgtggtgtaggccagcagctgtagctctgattcgacccctagtctgggaacttccatttgccttgagtgtggccctaaaaagcagaagggaaaaaaaaaaaaaaaaaaagtagtagtggtagtagtagtagaattgtataaatgttcctaaagttttaaagatattctttctgatttgaccacgcgtattccagctatttaagtaaatgttctccgcagagagttacatgttagtgcacagagccattaaatactgatggttgctttactttgtaagaccttactggtcttgctacctgcctttccattagaaaataagttgatgattctgtaagatctggctgagagatctatagccagtccaaccttcttctgtggccaaactttgttacatttatttatttgtttttatatgcaagagcttatcttttagtcccataaattgtgttattgaatcaaaagtgccctaggaaaactaagaactttcagtaaattatttgctttatttttgaatttccctggttgtgactgagatttgaccttattatttctccaacatctcctactataaaccatttgaccttgtgatggaactattaaatggatttcctgttgaatgagcagctgttccccaaaagcgtacagtttctccaacagcaaacatcaaaagactgggaagggaaaactctgtttttcttaccctttatttgaaaaagtgctggagttttagttgcccataattatgtgagataagagtttattgtaactagcaaataaactatttcctgctacttaaatgtaagtaaagtgaaataagtaagaaaagagaagtaacagagaagaaaaaactttttccatgaatgaaggctatctggggtactttttaacttagggtattaccttttaaaaataatgttgataaagaaataaaaataatgttgagagaaatcagaattccagaaagactggaaaaggattagaagggactttgagaaacccagaagctaaatcatgtcatgtaaggaaactacctaccattactttagagataaaaaacacaagtggtaatatcataggtaacctccaactttaaaaaggctgaggaaggtagtgtttgcatttctccagaagattaaaaaggtgggggcgggggtctaacaattacgagggagagaaaagcgtattttggttttaaaatccaagtcatcccataaaaaaatagtaaacctggaaaacattggactcttgactcacacaaagcatggtggctctttgtggaattcctctttaaagtcctttaatcctttattgtaaacttttccattttactcctcattatagattcagaaccctcattatagctatcaattgtatcattaatctgtaaaattaaaagatgggtgttatttatttggatctaatgaaaaagtttttcttattgacatataatggagcttagtgtatcaataatatctcccataatttttctgcccagatatgcccatcccttcctttagatttgcttctttcaaccttcttgctgtcatttgtgtttctttgttttgatgctcaggtgaactgactattctagactatgctactcaaaagaatatctctcttttgtcatgtaaagcaaatagcctcagggttcatactttaaatgtgacatctttgggatgttttgaacaccaaccaccctctttgaataagactttcattgaattctgtgttttctatagtgctgctatatgttaattgttttttttattttgatgccagattatcatgttattagacaatcctatttcatatctcttaaaataagaaatgactgagtaacattaaccaccatccatgctagcatgaaataggcttacaatgtgaacacctagttcaagaaatgatagtaacgaatttttaagtgaccaccctaggacactttctcatatgacacctgtattttaaagagtctctactcacatgcagtgttaaagaaaatgcaccttccaggcaatcaaaaagaggtccatgaggaataattaagcttttaatttgatattttcaatagtgaaaagtttgtaatcaagattgaggatttcaaaactactttagtgttttgtggatacacattgaagaaaatagaaatatctatctacctatctctatctatctatctacctacctacctacctacctacatgtgatatagtaattacctaaacaaaagagaatcagggatgctagtcagattcacttctgctgaaccatgcaggaactcctgttaatgcttttttaaagaatgagaaaaccaaatgttgaggttgaagatgttttcattaacttagcctatgtcagaattttgcaaatttgaatcattgtatttaaaagttgttaccagttgagagaaaaaccattatatctatttcctcattgtcagtttttttggctaataacagaaaggagctttgctttctttcagttattccacccactactttgcctcagagtcccaacccataaccttttttaaggatggaaggatttggtctcatcaccacagaatcttagtgccttgtctttcaggtccctggtgacagttcatttgcagctgaaaggtcaagaattgaggatatcaaataattgtagtctttttgatatggtacttaaaattggtttctgtggtaattggcacaataggatagattagtaattataagtaagtttctccatttttttcctggtgtagcatatatcatcttcaaaccttaagccttacagaatattcagtcttggaattaatttatatttgctttactttaatttcaaatgaagcaatcagtttaaatagcctaattcttaaatgaaatttcatattgatactgttaataacttataatattttaaaactcttcgaccttgtgagaataatacttctgtgccaaagtagattagaagaattaatttaatagagtattcataattccttacttcagttataaaaataacttttctcacatcatttcttatggacaatactttatcaatgccgttttactgattgtgtgataataatagcactgagaatttaatgtggtatccataaatgacacttttaccctccaagttattctctaaaaattaatatcttaggttggacctatggtcttaatgcaaatcagtagattgaggaattaatttaaatgaaatgagtatttcctcatttttagcacttggatttgtttgaactattctttaaaaaatcaagtaaagctgtaatcttaattagagaagtatgtgctgtagtaactagtagtttccaatactcacatgtcatttagcaaatgaaaatgaaaattgaactctcattgatatgcttgctgctctaccccttataaaacagtattaggaaaatttggcagagttttgctacaattgctgtatgtattttttctaaaactttctatgtatatgtatgtgtaaacatcatgtttaatcataaagttctgggagggagaaacttgtttgtattatgatcagttttatgatcataatgacaatgaattcattgctgtcatttgttggtctgccatgttcaatttcatgggatctgtttcagagtttgcatgtggtgctcacttttctcgccactatctcttgaaattataaataatgctttatgatcttttctactatctcctgaaatttcatcactaaaatagatggttttggatgagataattgctgtggtctttgacattttgattccaatacggtatttgacttttttggttttgatgaaaggccttctatctacatcatcctgatgcatattcttaaattataattaattcttataattatccaagagataatagaaatagtatatttggatttcatttcacactgattttattcttttttaaattttaagtatgagcaagctttttctgccaattatcagatctgacctctctgttagcaggtgttggcagtttggcacttgcatattattgctattagggtcttggttgttctaaaataataattagtatatatacaaatttatgttaaacaaaattaaaatgtggccaatgctgcaaatgttatcattgacataaaaatattaccttaaagctaattctattctatcctaatagaattattagcctactaaatatacttttagcctactaaaaattatagaatatatttttcacaggatgtgtagatagaaagatcaaacatatatgcattgtaaggtgacctcaatgtgtgtttatgtttttttttcctggccatcagactgttaatcttttttcataacactttgcatgactctgattatcaaatacaatttaatgcaagacttgaatgaaccctaaatgaactctcctgtggggtggtgaatttctttttagaggctgaaccgatcgagttcttccgagtgcagcaccattgataaccctttgccaggagaaggagaagaagcagaagctgagcctgtaaattcagatgagccagaggcctgttttacagatggtaagagaaaaatcaagatctcagcgtccatttattagtgttttggctttaatcttaaaacctaatactttccaggggttgttgagaaagcagaaaaccccattccatgctggttcagttgtggctctgtgactaagggcaaattgctggagcttgtttccacacttagaatatgctaacagtaatttacgacagtgtgttttactgtaaagcactctacttatcaaaggatgttcatattatcattttgttccttaactcatgtttccagctccatagaaccagtagacaaattaatgggatagatggtactgttttccttttcatcaaaattgaagctactctaactcaggaaaacaacttgatactgtgaaccagcctctctaaattcctccttcccttggcttcagaggccacactctatatttttgttcttcttttatgtcactgagggttttgagtttcttccccgacttcttgtagtgactatttttatgcacaaatcttaaataatgtttcctcacattctgatgcccggttctctacttttcttattcactagccctaagtggtttcatccatgtctacggcttaagcatccatttctgtgttgttacccttagatctttatctgtatccaactttgctcaggttccagatcttccttcagctccttgtctccacctgttgtctttaaacatcgcggatttaataaattcaaagcaaactttaatggggttttcccacaacttcctgcagtcattatcttatttagttacatcatgatctatctgtctctcaagctagactttaggtcagtcctaagttctccctttctagccacaagttgatcacaaaaactgttaagttgatcagaaactctggagatagggcccgagtccttcaggagattctgatgttcactaaaatttgagaatcattggtaggataaaatctgacaccttaacttggcatataaaacactttacatttggcttctgtcattattttctaataatacttctttttactccttttcattttctgccttcctgaacttcttactactcctggaatttttcaaggatttattcaaagcaataactgtgaatttgacctaggaaagtatgcagagttttctaaccaagtatttgttatctaggtaaaacacaaagtaggctaggattgcaatgtagtatagtaatttagagcacaaactttggggcgagataagtatgagttctaattggcccactgctaacactgtatgagaccttgagcacgtttttaaatcttatgcctaagacaccgcacctttaaaataggtttaacaataaccccatatcatagggctgttgaggagattcgatgagataacaataaattaattagcgcaatactgtttttcatctccttctagtcttcttgttgttttaaaagtattttgttaattattttatctagaagctaaaatagcttcgatgctaatgactcaagatctactcaagggcttaaactctgaacatcactgttttttatagaaatcattgacttgctttccttttccaagatttttctcaaccagtctcatataacactcatgcaataaacaaaatgaatggcaaagatatctgcaaactacagtggatgcaagaattttctttaaatacaagccaaaccacatttttttttttttttttttttgtgagaggcaaacaagaaagacacccaggtaatagaaatctatgtttgctcaaattagtgccataagcaaaccatggagtttcctttagaagagttcatgtttaaggcatagaagcatttcaacatcatgataaaattaaattgactagctccatgtaaatttgaatttgtacagctactaccaagatttcttctgcacattttttgaatgaccttgacgtaaaattctagggtaactagaaagaaattggacttataaaacaagtatggctttaaatcagaaaagggctttagaaaaacttaaaccctctacagagagtattaatgctaagctgtttcagactgtaggtactatcttactgagattaaattttacaaaggcttttttaatcctgcaaaacactaatgaaaataattgtataatgactttgaagttattcaatacttctaattcgagtctagtatataagagatattacagaaaggtattttcaatgttttgtgaccttgaccactgagaacttatggagggccaaagtttcatttgtgtccagattagattcaggagatctactgtatagtagtgtaacagtagttaacaatactgtattgtatacttgaaattttctacaaaggtagaacttaagtgttctcaacccccaaaagaagaaattggtgaccatgtggataatggcagtttaattagcttgactgtggtgatcatttcacaatgtaaacttttatcaaattattaagttgtgcactttaaatacatgcaatttttaattgtcaatatacctcaaaataaagctgggggaaaaaggacaaaataggagaataggcaaaatcaaaaatctacaaaaaaaatctacaaagatacaaaaaaaaatctgtaaagacgcaagtcagactagtagttacctttagggagtatagattgggaaaggccatgagagtgatttcggggtgctaggaaatgttatatcatgacctacatggttgttgcatgagaatatcaatctatatacttaaaatgtgtgtccttaaccctatgtgtgttctcctcaataaaaatttagataaacagaagtctgcatcatggctcagcaaaaatgaatctgactagcatccgtgaggacacaggttcgatccctggtctcactcagtgggttaaggatacagcattgctgtgagctgtacggtcacagacatggctcggatcccacattgctgtggctatggtataggctagcagctacagcttcaattccacccctagcctgggaacctccatataccatgggtatggttctacaaattaaaaaaaaaaaattaaaaaatggtaataggtgtagaagcctactgtcatataaatagagcagtcaaagaaggcctttctaaaaaggtgatgtttgatcagagacctgaaaaagattgatgtgagccatgcaaatatataaaggaagagcatttgaagcagagaaatgaaggcctaggccctgaagtggggatatgcacatttgaaaacaaaatgaaggggccaatgtgagaagaacagaatgagaggtgagaagagaggtaaaagttgaggtcagagacatagtagaggtcagatcataagagcattgagcaacattgtaagactctcatttagaagtcttacaacatgccatcttaagagtagatgggtggggagttcctgctgtggaacagtaggataagaatttgactgcagcagcccaaatggttgcgggggcatgggttccctccctggcccagtgcagtgggttaaaggatctggcattgatgcagctgctcagattcaatccctggcccaggaactttcatatgctgcaggtgtggccattaaaaaaaaaaaaaaaaggaggtgagtggatatagcaaaggcagaagctgggaaacttcctgtatgttcctgtagtaagcaggtgagagatgatgggagtttggttagagtatgagattctgagtacattttgaagttagagctaaaaggactggtgatggatgtcgagtattaaaaagggatgggtgatggatgtcgggtattaaaactttcctctcttagaagagtcaaagatgactccaagtctggggcctcagaaactggaaatatatagtttccacatgaagacttgaaaatgagtcagcttatcaggctgggaaatcagaaacttgtttacttatcgtggaaatgacccttaccaagctgtgattgtttgacaagttttgagctaggaccaatgccaatttagagcagcatttggctttccagaggtttttgttaccagaaagggagcagaaagaccagagtgtgagagctaagtcaaaagagttgtgcttcactgaagacaaatgctgaaatgattgtgtttttcattgtctcacatcattgattctttttaacttcttatcagtatactaatttgcattttgttcctcctcacctttcccacctccctctgaggccgtgtctttccttcgttctgtttcattagctttataattcaagaccaggttccttccccagaattggcactgtgcttctgtatccttaattccaggtgtcttagtaattcgtgtaattatgaacatgacatgactgattctgcttggctttatattatactccttttgacttatgcaattagtaaatcacaaaatgagaattaggacatgagaaagatacactctttgtcttaaaataatttattttctattaattttgtaggaggagatatctcaatttccccccaaatgttctgagttcagcttcctataaaataactaataactaattctaatgttaacaacacaataacctccccctttgtgcctatttttgtctttttggaaagaaaatacagacaaaatacttgttttaaaggctttaaaatttttaagaaatattttttaaaaagactttcctaatcaatttttacactaattattactgataatgtttttatagttttattgatcagtaaactatcttggaagacttctgtggtttcttttttatttgaaagcattcatttaacatgatgaaacccagtagagattttatgtaatggatcaccggagcaaattaacgaaaacacccaaaagaaacagcatttacccatggggacccattaaagtgtttgagaggttctctgttatgtttacatttaattaatagcccttttaaaaaagaaggtatgataatgttgctaaccagctaggaaaacacttggaatatgcctttgcataaaagtcagacaggcatcctgtactcctgcttcaaaataagagaaaaactgaggtgggataaatcctgagggtaatatatatgaaccttcatctcagattaaaagtttatctacttttcaggagttcccgtcctggctcagtggaaatgaatctgactagtatctgtgaggatgcggtttcaatccctggcctcgctcagtgagttaaggatatgacattgccctgagctgtggtgtataggtcacagacacagcttggatcccatgttgctgtggcataggccggcagctgtagctccagtttgaccccttacctggaaacttccatatgccacaagtgcagccctaaaaagcaaaaaaaaaaaaatgaaaagaaaaagaaaaaagtttatctacttttctaattaaattagaatatatagtgccttttcttgcctcaatcataaaaataatatttttctttaatgttaagactaacaaaaataggagttcccatcatggctcagtggtaatgaatccacctagaatccaggttgtgggtctgatccctggccttgctcagtgggttaagaatctggtattgcactgagctgtgatgtaggttgtagacttggatctggaattgctgcggctgtggcgtcataggccagcaactgcagctcctatttgacccctagcctaggaaccctccatatgccatgggtgcagccctaaaaagcaagaaaaaaaaaaaaaagactgaaaaaataaaacccaaattgtaaaattttcttaaccagagagaactttctcctctggtaattatgcttgaggcagatggattctcttctgtacaagatctttaagtttgaggtatattctaaaacctcaagcattaagttaatgttaaaaaaaaaaattccatttaaaatttttccactctctctggtgttttcttttgcctgaaagaaattctctgggagtcaatttttgaccttacccttttactattttttcatataattttataaaatattctttctttactaaatgcatttcatatgtaatgattttagatccaatgaagataaattcagggctgagatcatgtaaattgtaattaattgatgttgcataaatgaagccatgtgtatactttccattcaccttgttgggttttattttccttttcatccaatttttgtgtaaatctagaattcacaaaggtatgacccttcagatcatgaatgatgtttaggtggttttagaactctttgtggaggaactgtgtcttttaggtcaaccagcacatgaaggtgtggagaggactgcagtccgtactgtgaacagaaagaaagggcatgacaggcacagtttagccttctgggaatttagatacttctgaagagaaggaacaggagcacatcaaatatacatgataggaaaaatgtcagagacttggaggaaaaacatagcttgctacatttctatgaagctggaaattaaagtgctaggagatactttgtattaagaatcaataaactaattttacctcagaatcataaaagaagccataaaaaaatcattgtccaaaaaaatgtaatccatcaagaggattctagctttgttgtttcaagacatactgtttatgattatatgaagttattacttgatagactcaatattttaatgaaatatattattttgcagaaaagaaagattttaaagtgactaacttgaaaacttgtgaaataagtgcctaaagagtgctattgatttcccctcccatcttctaccctcctccaaatgaggtgtttcatctaaaatttttagaattaactgtagcttctctttttaagttcttccttttctttaaagtaatttctattatctattttttaatcaactttaatttttaaaaatgttcagtcattatctttctgatcctgtcttggtcatagctctcttcaccagttcttcaagaaattctttcctcctttacttttcctgcagtttctgatgtttccccaacctctgctctgttacctccttagggtcttctcttctcctacctatcctggtggtggatcagtaaatgttgaacaagcaattctccaagaaaaagaaagtatagacactacatatataagatagataaataataagtacctactctatggcacagggaactatattcagtgtcttcttataacctatcatggaaaagaatctgaaattgaatcactatgctctacacctgaaactaacacaacgtggtaaataaactgtacatcaataaaaagttggtttcggagttcccattgtggctcagcagaaacaaatctgactaggatccatgagatgaggatgcaggttcaatccctggccttgctcagtgggttaaggatccagcattgccatgagctgtggtgtaggttgcagacactgcttggatctggcattgctgtggctgtggcataggctgtcagctgtagctccaattcaactcctagcctgttggaacctccatgtgccacaggtgtggtcctcctaaaaagacacacacacacacacacacacacacacagagttggttttttggtgggggggataaagaaattattcatacatgcatccacttactataaattttactgatataaaggatatgtggtacacattttacaaataatattatcaacattcttcattgaacactatgtagccagttggttctcacaggatgcttttgatgaattttgtacttataaacagcaaggatcgcaatggatgaacaaatctagttttaacctgaatggttggttggcattttcacttatgtcagtaaggtaagagtgaaacgaagaggctctgtgtggcaatctgactcattcatcgctggtgtgaacaaatctcagttgaatcaaataacagaacttgaataatgaatgtctttcctcaattccccaattttttgtgctattcacaatataatggctacaacatggcatacttttactattttattaacattttctccattactttctttacacaaaaaaatcgatttatctgtttttagtatttatcactaaatttattttatttattttattttttagtctttttgtcattttagtgccacacccacagcatttggaggtttccaggctaggggtctaaccggagctgttgccgccagcctaagcagagccacagcaatgccagatccgagccgcatctgcgacctacaccacagctcatggcaatgccagatccttaacccactgagcgaggccagggatcaaacccgccaacctcatggttcctaatcagattcatttccactgcaccacgatgggaactccctttatcacctttttaaaagtcagttctatttctaaatgtatacaatttaatttttgataacagctgcatttaacaataggctagcaaaatttcctgacaacaataaattgtcatgagccagtaggaggtggctccaggataccactaagtgctgtctcttaatgctgccattccagaatattccagacttaatccttttctctcctcaccctacattcttgttttgtgtgtgatttcaacaactgtcttgatttcagctgacagggacatatatactcataatttctatacattcttttccagcccagactttttccctgagcttcagagtcacactccaaatatctacaggatatctgtatttagagttttcattggcatctgaaactcactaacccccaaccagcgcctgttcacgtagtcttcattttactgctaacatctacccagttgtatgggcttctcccttccacttacatcccatatccaatcagtcaccaaacgcactgattttatctgccagatatgtcttgattctgttgttgctgaagttcctaagttgacctgatctatacttcttgctggggatactgaaccagaaccctaaatggctttctagctctgggtctttcttttccccccaccctcttttttcttctcttccaatttatcctccacagctgttggagacatctacttaaattacagtcttcctatatatcattttctccttacaactgtccacttgctcctcattaggatgtaggatatggactaaactctttagggtaggcgaaaattccttctgtagtctgaccagtttctctacctcatgtctcatccgtgccccttgtgcacactttgctttcctcacaattctgaactgcttgtgattcctgtatacaacacattttgctgtctcttggcctggaattccacccaaacttttttggctaatactttggttcaattcaggccccacctcttccagaaaacctcctctgacctcactttctcaacaaataagtcaggttaggtgaccttctttcatgctaccaaaataactccagcatatctgcaacattttagttgccttattcagttatagtcatttatttctatatctagctgcctaaccaaaaaccacaaataggtttcttgagaagaagaaactatgtacacagctgagtaaaaagcctactcaataaatatttgatggggatattaatgaataaacctaaaaaattttaaataaaatactcctcagggtttttttaagcagtgtgttttacatctaggatcccaagtcagatttgttttttacttatagtacttgagacaatatcatctgcatcttctaatcaagatttcttcctttttaaatgaattataggaccttccactaatttttaaagtattacttagaatgctatttctccaagggtttttttatagagaagttgaagcaacaccagattgtagactaaattcacatcaagaaggccctgaaatgcatctttgttttaagactttaattcattcattcatcaataattatttagtactcattttgtatctggattaggattacattaggattgtaataataaaaaaaaaacaataagtggtttaagtaagaaactagggcagtacggaaaacatgaatatgtcccatgttagaaattactgacaggtattaagagaacaccatgagagttaggagataagaggaggaaacatccaagttgaaaccgtctgaagctttaggtatgagtgctagaaattgattggttgaggaactattgtagggagcactttacattaaataatgtattttaagtattttatttattctgaaaaataaattcaaatttgacatgcatgtcttttttgccaggttgtgtacggaggttcccatgctgccaagtgaacatagaatcagggagaggaaaaatctggtggaatatcaggaaaacctgctacaggatcgttgagcacagttggtttgaaagcttcattgttctcatgatcctgctcagcagtggtgctctggtaagtcatctaacacctaaggcttaaatagattaagtcaggaattttttttttttttagggccacacctgcggcaaatggaggtgcctaggctaggggtcaaattggagctatagctgccagcctacaccacaaccacagcaacgccaggtctgaaccacctctgtgacctacacaacagctcactgcaacactggatccttaaccctctgagcaaagccaggaattgaacccacatcctcatggataccagtcacgttggttaactactgagccacaacgggagctcctaagtcagtatttttaataaatgagttggaggataaaaatatcatgacaatctgttttacttaaaaattaatcctatgattggtaccaaggacaaaagtttagttagctcagtaaatatttactacatgccaggcattattcttgctgtcctaaatgcagagatggataagatccaggtactttcctcaaggagcatagggaacattagggaaacaagaggcactagtgataacagagctgaaatgtgtttgtaagtgaggtatatacatgattaagctgtggagcaagaagagttgtctgtttggaatttcagagaggtgaataggaattttccagccaggaagatggcctgaggggaacaaagcataaaatagcatgacatgctccaaactatagaaagtattgtgggagtaagagcaaatccagggaggtgggtggtgaccaaagatactgtgacaaagataggcagcatcagctcataaagcatcttatataagggaaaaacggactgtggttttagggtgagaataggataggtttctcattctggtacatgtgcctaacaccttctatggtgtgtgaaagggaacttgtagagtaaaaagctccctgagccttttcttgtttttctctcctgctgacactaatagagataagccattagaagcctagttccagctgaagattccactggaaattccattttactacaaacagaatacccaagaactttataggtttcctcaaagacaatctgtggacctggtttctgtttcatgggtgcaaccatatgggagacttccgagtcagagacaaaggacttcatttctcatggcatagaaagcagcatgaacctgaacatgtgtgtgttggcttcctttgtccccaagtcctatgggggcacaacagggacctaaatgagcattgcatacacactgggttagcatcatagcttaggtgcactgagcttagggaaaccatccttttatggcaaacagcaaccttgctctttgtcccagaaggagatactaccccatccttcaaggttgcttgtagcaaaaacaaccctgggaaatgacctagataaagagcagtcagggccttgtgttcttggcatacccaacaagaacttgcaaaagtgctcggggtcacaatgcattgtctctcccaacaatttcctgtataaaaaacagaagatgtactaagaaaaacattgctcatctgatggaatggaagtaggaatcttgataactttctacattttctcatatttctaataactgaggaagttcataagtcatgctgagtcacgtatgtaaaccaagacttttagaaagattacaaaatattaaaagaaaaggttagaattatcccttgttcaaaatgtctaaaaaagggagttcccattgtggcacatggaaacaaatcctgctagtatccttgaggatacaggttcaatccctgacctcattcagtgggttagggatctggcattgccgtgagctgtggtataggtcacgatgtggctaagatcccacattgctgtggctgtgcataggccagcatctatagctctgattcaacccctagcctgggaacttccatgtgccatgagtacagccctaaaaagcaaaaaaaaaaaaaaaaaaaaaaaaaaaagaagaagaagaagaagacattgggggcagaggcattctcaaagctgaaatttgaatgcatcctaaaaggaaagggagagatatctcaagaaactggtatttttcactcctcaagtttgctaattgaactagatttttaaaatcccttaattaagtaataataccttaattaatgataaaaataaataagaagtaatagctcaaatttagtacatatttttgtgtttcaagatctttatatagattttcttttttattttcaaatatcttgtgagattatggtattttactcattttaccaatgagaaagttgggggcagaattttaaaagttactttgtgtcccaaagctagtaaataacagagtcataactgaaggctaaaatcaactgaaatatcttttcatgactcttcagactcctcagaaaggggggaactcactaggtagaaatagatgggtagtgatggaaatgagtagcagaaaagcccatgccccaaatcaggcagagctcgcacagtgacctccttgcctccttgttcccagatccataaaagtagtccttgaaagtaggagccctgcagcagaatcctgtttgaggccctgacactggctgaagcaaggtgtgcttttctttgtggtcaagccttttccttgtcttcgcatttaaaggactgaggcattgtctgggtttctgtttaggtagtttgccctgttcctccagaacttggagaagggaagcaggaaatttctgaggactggatttcagttcttgcattttagctacattgactttcagaacctctgccagctgctcgagtcttctcttagcatcttagtgggtgtgtccattctctttatcccaacttctctattttcttcagtattgttaataacattttgcaagaagtactaaggatcaggtattgatagaagaacttgggataaggaaaataagaatgtcacaggcctttgactatggataggcatccagtgttaaccattgaggctacaggtccttttgctttcattttctccaacaaggtgaatattgtttaaacttgaaagaaaattctaatactgtagacctgtgtaggtcagcagccattttcagtggcttctgggagctcagttatttaattccattcaaatcatgtcccaatgaccttgtggctctgacctcagtatcatcatctatcatttactaaaagttcttggaaagtgttgaaaggtgccacattggtggaataaatgtaatagtgatctgaagagctaaagcttgtaatgaataataaaatactggtgaaaaactcaaaggaagaaactttcttctgtgttctacagccctgttacactattggactcattcatttagaaaacttttccttgcctccttctttgttcttgacacagtgctaggcactgggaatgacaagtttacaagaactgaaggagaggctctaaattctgtactgctgggttaaaggagagtgcagcttgagagagatttataagaagggatgactctggaatcatggcttaaattcttaggactcatctaatttgaagggagataaaaggggagatgagtggagctcttggaaagtgtcagagatcacaattcttttagaggattataaataatttcattcttttgcaccctcttttgacctctggtgacccgctgcctgtactattgagaaggctagaactaaatgctacacagtagctataaaccagaataaagtcagctagcccataacagtattctatgtcagtattttctttatcagaattttatttcctgtttttttgccataaatcataagcttaagttgtgcatgaatagaaatttgaatattattttcacaggcttttgaagatatatatattgaaaagaaaaagaccatcaagattatcctggagtatgctgacaagatatttacttatatcttcattctggaaatgcttctaaaatgggtagcatatggttataaaacctatttcactaatgcctggtgttggctggatttcttaattgtcgatgtaggtacttttggataaattttaaagaggatttattcttatgactaagtgttctgaaaaaccttcaccgatgttgtatattatcatatttagatagatccaaaacatttttttccaaggcttgggtatacattacatcagctatgttctcaggcttcctctatgagaaatctaattttttatactttgtaataatgatttaatatttcattttttttgatttacctttatatatttgttacatagttattacccagaaaaataaatggtaagatgaatgctttataatataatagtttttttaaaagtctaaccaaaataagaaataagagaaggaatatagattatttcttttctcttaaacttataaatatgattgggtcttttaaagtttattataaaatatttaagctattttaaaactttaaaaaaatatatcctaaatatagttattttcatctttagattaagaaaaaagttttcaagtagagctgaatttatttttagttcagaaagagatatggctgtttaataatgaaattatttttgtatttgaaaatataaattctcaatatttaggggtaatatgcagaattcagggaagttatatagcttcaaattgaagtatttaatattttgaaaaaagctaagtaaaaaaaatgtgtatatgtgtgtgatgtctgtatatgtatatgtatgtgtgtgtgtatacatatatatattataatgaaacagagcaaaactccactcagtattcctgttaatagagatgcaaatctaggtgtgcagatttgggggaggagctgtgattattttttttctttcttaaaattgagaaatgtatctatctagcacagttgctctcagtttaatacctgaaccaacatcattggtgcatgtgaatggaaacttgttagagaagccagttcttaggacccagccaagacccactagttcattaactttggtgttgggacccagcagacttgtaacaagccctccagatgattctggtgcacatttagggttcaaaaccactaatctggttttatacccagaagatgggcttgtttgatttctgtgagcttcttgattatttgaaacttttacttgcttgagcattattcctcagtatgggcattatatcatgcataagcagatatgtacataaataaataaataataggcatatatatgttctcaactacaaactatactttagttttctcaataatatgcatatataatagtcaatgtcataacattcacttaacagtggtttggagatcaggtttaccatttccttggggactggtcaaattataatagacattttagaacttttttctgattaaaaaggatttctttttattctgattaaaaagtacacataattttgtaagtgtacttaggtggaaaataatggatctgaaagtctgagtgaatttaaaagtgatgtgaggattaattagtaatgctggttatgtagcgtgaggacttaaaaagaaataataattttacacttagtgagagagacatttagaaataactaccctataacaaaacactctaatatgtcctggtttaaaactcagttcacctgtttccagtagcactagcagtgaacctatgaacaataaatttttctacttcttcagttgttaaacataaggaagtagatgcttaagctgttcttaatcttccctggaaaacttcagtctttcagtcatcacttaatttgtaatgaagaactgcattccagacatggttcttaggcattgcctccagctgcatgtggtgtaaaaacaatgggtattttaaatggaacttattcagagactgaatatatttacagatccagtaaatatatccactgctccatcatcaaagtgtattgattttggttctgtccttgttctttcttctgagataattaaggataagaacacagatttctattactggttgcagtaattgtggagagtctaacatgacaaagagttttatttgtcttatattcttatatgttaattgggaagccagtgaaatcacctactctcctgttctcttcagtataattgaaattgtcccccacaaatttctaccaggaagatctttggtgtcaattctgagaaattgtaggacagaataattttgtggagaatttggcccatctcaaaatcatgaatcttcaaaatgcttttctttcttggttttgtttttttttttttttttgctttttagggccacacgtgcggcatgtggaggttctcaggctagggatctaataggagctacagctgccagcctacaccaaagccatagcaacatgtctgcgacctacaccaaagctcactgcaatgccagatccttaatccacagagcgaggccagggatcaaacccacaacctcagagttcctatctggatttgtttctgctgtgccatgatgggaactcccagaatgcttttcaataaggtttatactaggatttagatttgatttagtgagtatcacactcttacgacttagcttcagaatcacacactttgccctgggctttattccagttgactttttgatagttgctttcattaaatgttgagaatgaataagtaagtacaaaaccattggctacaaaagtgtgaaaagcatgtgtgatttttattcaactataagaaataactttccttctattatttcttcgtatttggggttaattttcctttaaatctatttcttgaaaaaaggatccatcttacctatttttaggcaatgactagataactttatatataaaatcatattgttcttattgagctgctcttaatgatttttttgaaattgactttttctctttatgctttattatttccttgaagagattaatgaaaaaaaatttttttgtaggtttctttggttactttagtcgcaaacactcttggctactcagaccttggtcccattaaatcccttcggacacttagagctttaagacctctaagagctttatctagatttgaaggaatgagggtaagaaaatactaaacttcctattataatattcataattcttaatggagtacaaaatatgaaaaaatgtgtatgtataaattatggactgtttgtatatacacgcaaatatacatatagatatagatatatgactgtttatgtatatgtatacatgtgcatatacacacagtatttcagtacattttgcttaaaaaagagtaaatcaaatacagcagtgcctccttaacagtatatattaggcagtgatccaaataagtgacttttcctttcttaaatgaaaacatttcctgtgtaaggaaattcaagtaaattctcagcaattcatgaagggcttacctgtatcaggtgctcaaataacattttgtaaggaactactctggataggtgcataagaaacaacagagaagtgaagtatatcagctattacttttaatttcattcttcaaatatatggttcagtgaaagtggaacgatctccaaattatatttgagaaaactaaagctctgagtttactcaatttgcgctaggctgcatagtgcctgcaaagagattgattttgtagaacaaacaaggtgagataaggagtgactaccagcaacccagctctagggctgtattaaaccagcagcttcttcataaaatacatggaggaaaatgaccttattttctctaatgagtccatgccctcttttgttgctgctctccttgaatttctttttctccagatatattcttgctttctcaggcctccattttcttggcccagaatgcttctccctaccctgtctcaaccctaactcatcagtatagcaaatgcctactcatcctttaagcctcaattttttttattttttattttttggctttttagggctacacctctgaattatggaagttcccaggctaggggccaaatcagagccatagctgctggcaccacagcgacagcaacataggatccaagccaaatctgcaacctatactgtaggtcacagcaataccagatacccagcccactgaaggaggccagggatctaacccacatcctcatagatactagttggattcatttccgctgagccacggcgggaactccttaagcctcagtttaaatgtgccttatctgtccaccaccaggtataattgggcacctttcctatacattcagacacataaaatcttcattatattacattgtacttatttattaatctgcctacctctctatgtgtagtctctgaacaatttaagatgcaaattagtctggttcactgcttctctaagtgtggtcagcatcctctgaaaacttactagaaatgcaaattcctagattccaccccagatctactgaataataaaccctggaatagggctcagaaatctgaagcattagtgaatattagacatattttagtctagcagatcactttatccctgctaacctaattatgactataacttcagctagttaatatgtccagtgtatataacttcagctagttaatatacccatgtgtatgagagatcatgattacaaaaaaatttttcataagtaaaagtcaagtactttttgccgtatgtttcttcacacttcagggtcattttgaagaataaatgaaatcatcatcagaagtttttgtagttagttcctttcaagcttgaggttcttgaacttactgactttcccaaacagcttctcaccagaacaatatatatccacatccctctggtaacagctgtggcgtgggttcaatccttggcctgggaacttctacatgccacaggtgtgaccaaaaaaaaaaaaaaaattttttttaaaaaagactaatcagtactcatgttctttcagcaaacattttccacaccaactatgtgtcacattttgtactgtaaaaaaagtacaatggtaaatagaccccagttccccaagagtaaggaccatggtcatggagagacagacaggggaagagtagttagttactctgtggcatttgctataaaatagtaagcacatagtgctacaggagtagggatgggggtggctacttgggggagtctgggaaggcttcacaagaaggtgaccttggagccaatgagtggtccacaagtcaccagtaggtagttactccagacagagatgcttcttggtagagaggcatggacttgattatgcaaggtatgtttgaccagtgaccagaaggatcaaggtgcttaggtgataagcatagtgggggatggggatgggtagcaggaaatgaagatgaaaacgtaggtttgaaaaaagagctgaccactttgaattctgttttctaatcctgtgcttccttaggcttttagggtcatgtatactgaaagtataaatcatctatccataaagaaagcatacctgtaatatttttcatttaatttcatgcccctgtggaacctctacaggtccatggaccccagggtaataactgttgctctggaccaaaggtcaacaactaaaacccacagcctggatgcctattttgtaaaggaggtttcattggatcccagccacccccgtatgtttatgtctgctccattgctgcaatggcagaattgaagcgtcaccacagagatcatataacttgcaaagcctaaaaatatttcagaaaatgtttgccaattcctgctctggacaatctcaaaagcagtcagaggtccttagtatcttttcttttggaaatgtcttgagagcctccttgatatatgtcaaaaaaaaaaaaaaaaaaaaaaaaaagagggagcacatgcactttagttgaaaagttagtctctaacatatttgcattcaaactcagattacaactcagtttaagaagatagcaagcttgtcaagatgaggtaattcagaaaatctggagagtggtaaatactgtggtagttgccacataggaacactgggtggcaagaggcctgggtgatcaatagcagtggaaatgctgaaaagcagaaataaagggagtattaaagataagctgtacttaatttttgttttagctgggaccagcactatttatatttagccaaggacttatatatataaaggtattttaggcgttagaataatgaatttgaaaaaattgttcttattctgcagataaatagaggtcccaaggtcttaactaaatttccgtattgcacaactagctgaaccattaaacctaaggggttcaaaccatgaaaagattcccagtcttaactccagctcatatatactagtagtttctctatatgggaaaatgttagtactggtaattctaggactatgaacctttaaatgtacattttacttattttaatcatttgtatttataaatttctttcttttctagagcatgcagattttatgacatcaccttacatatatcaggtttttggtttattattttatttattttttccatttatttaagctgccatatcatcttagtgatttgttttgtattcttgctcagtagtttcactgtgtgatcctcatgtatttttgtaaagtggttgatcgcggggctcctttctcattttgtcctgcttggcacactgctgagcacatagtaggcattcaataaatacatgttggttggttgatttatttcttaagtgtttaaagggtggcttttctaatgtcttgaattctgcattgtgtttctctaatgttgcccacttaacattcttactaatcctaattattcttttctttcgaatgctaggtggtcgtgaatgccctcataggtgcaattccttccatcatgaatgtgctccttgtgtgtcttatattctggctaatatttagcatcatgggagtaaatctgtttgctggcaaattctatgagtgtattaacaccacagacgggtcacggtttcctacaagcgaagttgaaaatcgttctgcatgttttgcgcttatgaatgttagtcaaaatgtgcgatggaaaaacctgaaagtgaacttcgataatgttggacttggttacctgtctctgcttcaagttgtaagtgacccctcttatgaatgcttgctattttagtgtgcacctgatgaagaagctgcctctgttaacataattactaagtaaaaattaaagatactttgtgactttcaaaacagagttggtcttttttagaacatgtgcctataaacatgagttaagaagcataggttctgttgaatttgagagttgttaatccataatcaccatctgggagctacccaacccactggctattgtgccatctgaatgttgctccaaaaatgaatagtcactttttggactgtcactcttacgctacagagaaatgggatggacttcccactggtaccgaggatccttaagatttggagaaaaatatttccaccccttttcataaaattctccccctctggaaaaacaaaagttcatgtacaaaactcagtaagcagtttagcagttgtaacaacctggaaataattaactaggactaagatttagaatgtgacttgggaatgcattctttttttttttttttttcttaacatagcatctttatgttaaattggtattttaaaattaaatgggctcaccttatctgcagttttgcatctgcctaatgcaaggggcttgagcaggggcagattttggtatcttcagggggccctagagccaatcttctgctatatcaagggatgactatacagtaaaactcactaacttagtattaatgaatattgtaacattaaacagactaaattcatatatggctgttttagagtatgaggttcatattcagattctataaatgttatatttacaggcaacatttaagggatggatggatattatgtatgcagcggttgattctgttaacgtaagtattggtaaacataacacgaaactctacagttgtgaaaagctcgttagcatagttaggctgtttgcaaacagcagttccaaagagcccagggtatacacacacactaaagaactttcacctggtagagcctggtagttacctgtgcagcatttggaaacagagcttgacttaaattcaggctctaccacatcctacaagcttgcgactgactttgagcaaattattttctctctgagcctgtttattgatctgtaaaaggaaaataatttactgcctaccttatggggttgttctgaggctccaactagaaaatgaagtagagcacagccttgcaataataagtgcttggtaaatatttgtttatcaaaataaaaataaaataatatattttattcatttaatcatttttactgcttttatattttcaagtgctttgggagagttcatatgaaataagtcccacactgaaaaagtgtgaagactactgactctttcatgttgtcacaaaatccaaggaagacacttttataatcaaatgaaaaaaaaaagcaaaatgtatataaatatggtatctcttttactgttttttttttttttttctggaaacaaaaaatatacattaggtcatttacttactaaatcatcctacaatctgagaacaagtagtgcaatggataagacctttgtagttatttgaaggttatattcataataagcatgtaataaatatttatttagtgtaaatgttgaataaacttttagaaatgattatattgaccctcaacaacactatagcttctgaaaacatttacctaggatagcattgttcgggttaccttgttaaaaccacgtgaaaaagaaaatgatggattttattgtcaacatactgctaacttctatgaattttctaggtagacaagcagcccatatatgagtacagcctctacatgtacatttattttgtcatctttatcatctttgggtcattcttcactttgaacttgttcattggtgtcatcatagataatttcaatcaacagaaaaagaagataagtattttaagtttttgttattgtgctgaaaagaaatgaacaattatttcctcaaaatataatgtgaaatttaatttgatctcagtgagtaattagtcattagaatttcattaatttttaaaataatcgactagggagttcccatcatggcgcagcaaaaacgactctgactaggaaccatgaggttgtgggtacaatccctggcctcgctcagtgggttaaggatccagtgttgcctcgagcagatgcaggacacagacgaggctggaatctggtgttgctgtggctgtggcatacactggcagctacagctctgattagacccctagcctggaaacctccgtatgctgtgggtgcggctctaaaaagacaaaagacaacaaaataaaataaaataaaataaatacaaagtaattggttagtatatggttacagatatgtttaatttcattcatctctgcacagaaaataatcctctcctaaatcatatttttttttctttttaatgacttttatttgtttccattatacctggtttacagtgtctgtcaatttaatactgtacagcatggtgacccagtcacacatacatatataaattcttttttatcacattatcatcctccatcataagtgactagatatagttcccagtgttatcagcaggatctcattgcttatccattccaaaggcaatagtttgcatctattaaccccaaattcccagtccatcccactccttctccctctccctcggcaaccacaagtctgttctccaagtccatgagtttcttttttgtggaaaggttcatttgtgccatatattaaattccaggtataagtatataagataatatggtatttatctttgtctttctgacttacttcacttagtatgagagtctctagttgcatctatgttgctgtgaatggcattactttgttcttttttatggctgagtagtattccattttgtatatataccacttcttaatccattcatctgtcaatggacatttaggttgtttccatgtctcacctattgtgaatagagctgcagtgaacatacaggtgcacgtgtctttttgaaagaaagttttgtccggatatttgcccaagagtgggattgctggatcatatggtcataagttagttctatgtatagttttctgaggtacctccatactgttttccacagtggttgtaccaacttacattcccaccaacagtgcaggagggttcccttttctctacaccctctccagcatttatttgtggacttattaatgattgccattttgattggtgcgagatggtacctcatagtagttttgatttgtatttctttaataatcactgatgttgaccattttttcatgtgcctatttgccatccatataccttctttggagaaatgtctattcaggtcttttgcccatttttcaattaggttgttggcttttttgctgttcagttgtataagttgtttgtatattttagaaattaagcccttgtcatttgcaacgtttgactaaatcataattatttttaagcaatatatcaactattcagtttttttctcccaatgtacccttagggaattgaggaataaaattcaatgcactaattatttatgcaaaacatatttataagtagttaatgtagtctgttctaagccagggttctgtatggtatgtactgggctggcacttataggagaacaacataagatacagttcctgagctcaaggagttgatattatagcagaagaaattgtataggtcataaaaattaagatttttcaacagttttttgtttcattgatgtttataacacctgtatcagccataggaccacaaactggatggtttcaaacatcagaaaatgatcctcccacagttctggaggctcagagttcacaatcaaactttgttggtaaagcctcaacatctctagaggcagatccttctttgcatctttcagcttctggtagctcaaatgctccttggcttgtgacagcataacctcagtctcagcctctgtggtcacatgacattctctctcctgtgccactcctctttgtatggggacaccagtcatgttggattaagggcccaccctactccagtatgaccttattttaatttaattacatctgcaatgacactatttctaagtaagttcagtctgagatactaggggttaggactacaatgtatcctttttttttttgaggggtgaggggacagagttaaacccataataccaatcataagaggagttattattatagcctttgttttgtaaacaaggaaaggcaagagattttgaataatttatccaagatgatgcacctggtaagtgaaaggattttaatagtcagtagtcgatcccatgtaccttgtatattgtttaggccctttcctctgccatacccccaaacactattatatgacatagcgataaatgtaataagaaaaataaacaacaaaaaatgtaaatgggcagtttgaggaaaagaagatacaactatagaaagttttatgatggttatgataattgagcaggttttggaagaagagtgagaagacatgtagcaactgggaagcaaaaaaatggaaaatccacatgaagggtcaaagaaatgtgtgagtacatacacagtgctgataaaggaggcagcaatctgggagaaataccaagctatccagtttgggtggacttttaagaagaaaaatagtaaagatgtggtcttgatttgcttgagagcagatctgaaaagccatattagatacctatcagtaggatgtatctttgaagtgtttagagcaaggaagagcatatagcaggatattggcatttgatggcatggctgatctttttatgtactactttacacagttatctctgtcacattttagaagtctagagggcacagtatccccacttcacctctcagtggggttgtgtgacctgcacgtgttctgactgctaagaagtagcttccgtcatagatctaaccctgaagtctctttttccagagattttgaaaacttagctttaatttaaaaaattactctagcaatcatccagagaatgattggggagagaccaaaaaacctgctttatctgccacctagaccacacttaattcttcaaattagtcattgggagcattggagaataggagatacattcaattaaaagattttagggggtctacagtattgtttgggatttgcaggagaataaaatgtctaagatgtctcagttttctccaagttaactgagttactttggctatagcctaaccacaagaaaagacacctttgaaggatgagtaaaattacaagagaaagtgatttcagatgttggcttagcacctaagaaaagacagatgtacatgcaatgaaatgtcattagtggctatgattgactattcaggagtgaaggtaaatgtagtaaatgttaaatgttatataatcttacctttccaaatacaggtgtttatttgtcaaagaattttttaattccatgttctattcttatattttatatctgacagtcaaacttatctactcttatcatacatatattcatgcctttaagcagatgatcttgaataattaatagttaatcttgaaaataattttacaaaatataccctaattccccatttagttatttttcctactttatcattatacatgtatatatgtgatccataagcacacacatatggttccccatcattccttgttaggataaacggatatgtgtatctagaaagagcagtatgacaataatagaacagccacagctctaactgttttaatcctcttactcttaaatgttattcttacaataagaattgccactgcaggaagctgggttggagagacaccattatcagtaacatcaggcaaaagggttcatatcataaaagggaaatgtatataatgtacttacacaaatgactggaacagacttaggaacatgtgagtaaattctaacatcaacccttttcagtatctgtaaccttatcgggaaggtaaataacaacaacagaaaaagtacataattattattgaggacttgtgcttctggcattatgtgtttagaatgcagtgtcttaactgatcctcacaacaaaccaatgaggtagttactcttgtaatgacaggatgatttaaccttaaagagatttaaaaacttgcccaaggacaacagagataggatttgaaagaagatggtattacactacaactgaggtcttaactactgtataatacaaccctgacatagagtgtaaaggctaacctgacttacagaatgtctcccacccagcttttaaagggccatattttacaaggtctacacatggtacaataaaacaaagtaaggacacaatttctctacaagagcactttgtaatctcctctcagtgtcatcctacccgtcattattttgacaaccagggaagacaaaacctgctgccttgatttttacctctaattcagaattatcttcccagtgttaccctaatctcttgtaaattcttggcatgctatgatattcagcctctgtcagagagcaatagagtcagggcttctcttgacattggcgtgaaagttctctctcaagcatcagtagatgagatgaatgccaaaattacacagactgcatatcaaataaaggagatgtaaattaaggtaagactgaaagagaatccctggttatcattaggtatttgatcaataataaaatgcaataatccaggaaaaccataaacaggtcatctttcactccagggccctacaagttaaataaggatttcagagctataaattcccccaaattcctagtgacatggattatactagtttatgctataaattaaaagtttacattacagatcagtgaggaatatgcatgaatctatttaaattacaaatagttttaggaaattaacagagtctaaaagagtaggcaaagcttctaggtctcctttatacagtgtagaaggatcaaaagctttatttagatgttatcttttttactgttgaatcttcagtgttgtatactcaattataaagtccttcaagtcagaaactctggattattggtaattttctcaacatctagaactctatgatgtgtaaagttcacacccaatgaggtgtttatattgaaattcctttatttggaattgaaaaggtaaccaaagatttttaatgaataaataaatttattatatatatatgtaccaaatatatggatatagatatataggtatagatatatactatttgtggagatatatatatatatatatatgtatatatgtgtagtatatgtatatactacatacattcatgtgtagtatatgtatatactacatacactcatttttatgctaaaggattatggtatattaaaattaatacaaatgagtataaaaatactatttagcttctgtttttggcctctactcttttataattttttttattttcccactgtacagcaagggggtcaggttatccttacatgtatacattacaattacattttttcccccaccctttcttctgttgcaacatgagtatctagacaaagttctcaatgctattcagcaggatctccttataaatctattctttctcaatgctattcagcaggatctccttgtaaatctattctaagttgtgtctgataagcccaagttcccgatccctcccactccctccccctcccatcaggcagccacaagtctcttctccaagtccatgattttcttttctgaggagatgttcatttgtgctggatattagattccagttataagtgatatcatatggtatttgtctttgtctttctggctcatttcactcaggatgagattctctagttccatccatgttgctgcaaatggcatgatgtcattcttttttatggctgagtagtattccattgtgtatatataccacctcttccgaatccaatcctctgtcgatggacacttgggttgtttccatgtcctggctattgtgaatagtgctgcaatgaacatgcgggtgcacgtgtctcttttaagtagagttttgtctggatagatgcccaagagtgggattgcggggtcatatggaagttctatgtatagatttctaaggtatctccaaactgttctccatagtggctgtaccagtttacattcccaccaacagtgcaggagggttcccttttctccacagcccctctagcacttgttatttgtggatttatgaatgatggccattctgactggtgtgaggtggtatctcatggtagttttgatttgcatttctcttataatccgcgatgtggagcattttttcatgtgtttgttggccatctgtatatcttctttggagaaatgtctattcaggtcttttgcccatttttccattgattgattggcttttttgctgttgggttgtataagttgtttatatattctagagattaagcccttgtcggttgcatcatttgaaactgttttctcccattctgtaagttgtctttttgttttcttttgggtttcctttgctgtgcaaaaccttttcagtttgatgaggtcccatgggtttatttttgctctaatttctattgctttgggagactgacctgagaaaatattcatgatgttgatgtcagagagtgttttgcctatgttttcttctaggagtttgatggtgtcctgtcctatatttaagtctttcagccatttggagtttatttttgtgcatggtgtgagggtgtgttctcgtttcattgctttgcatgcagctgtccaggtttcccagcaatgcttgctgaatagactttctttttcccattttatgttcttgcctcccttgtcaaagattaattgaccataggtgtcagggtttatttccagattctctattctgttccattggtctgtctgtctgttttgataccagtaccacactgttttgatgactgtggctttgtagtatttcttgaagtctgggagagttatgcctcctgcttggtttttgtttctcaggattgctttggcgattctgggtcttttatggttccatataaatgtttggattgtttgttctagttctgtgaaaaatgtcatgggcaatttgatagggattgcattgaatctgtagattgctttgggtagtattggcctctactctttatgagtctatatagcaagaaagtaaacaaattatcattcactagttttatttcttataaccatttctaatatatttgttatttagcaatgaaatgcctggtgaaaccagtagcagataaaatagtataaaatagtaccagcacatagtataaaacaatatagattaggctaccaaaagataattaagccaataattattgcatgtaatccatatattttatatattatgcacattaccttatatatggagagtcatatgcctacacgtgggtaatcccttaaacgagctttatttctggctatcttgcacataacaaaatgcatttcattttttaaaattgaggtgcagttgacacaacagtatattagttccaggtatacgacataaggatttgatgtttgtatacacagcgaaatggttaccataaaagtctagttaccatctgtcaccagaaatatgcaatgcttcacaaatttgcatgacatcctagatcagaagccatgctaatctctacatgattacaatcttagtatatgtgctactaaagtaagaattcatttcatttatgagtacatttttaacctgtgttatgatctgaaggaagatctggacaatgattctggttttaactaaattctttttttttgtttctttaccttggaggtcaagatatctttatgacggaagaacagaagaaatattataatgcaatgaaaaagctgggatccaagaaaccacaaaagcctatacctcggccaggggtaaaaaaatatatttttagcatgtagattttcaactttttaaaattcatctttaatatacaactatttcttaaacataaatgtatatattttaatattttgatcaaaagtcctcataacaatatatatatattgaataccatcacagctcttaatattccctcttgtattttattttttctgtaaaaatgaaaaacaatctatatgcttttactctacattagctatacaatttactattagtacaaatggcctgtagagaatcaaaataaaatgaacttttgaggtgttccatcgtgactcaacagtaatgaactcaactagtatccatgaggacatgggttcgatccctggcctcgctcagtctgttaaggatctggcattgctgtgagctgtcacgtaggttgcagacactcttggatccaatattgctgtggctgtggcataagccagcagctgcagctctgattcaactgctagcctgagaacttccatattccatgggtgcagccctaaaaagatttttttgaaaagtacttttgattgaaatttaatcttgagggctttatgatgtagtcatggctatctatcagttgggtgaaactcacatgcagatctttgatacaataataaatagtgagagaaacagttggactggtcatcaatctaaactttatcctactctgggatcaaagaccagaataggctcagaaggaagtattgatcttagtggtcaaagaatagtttttattcctctaaaaattaaaatcagtttaaatgcattatatacctttcagtttctatccaacataacataccttgcaagttatggctgaaaacagagtatcctaaagatgggaacccagttaataccagctgcctacgtgaggattacccagcactttttaaggacacattgccagatttcacctaaacttactgaatcaaatgtatggatttaaagctgatttttaattttcagtctcttacttgatcttgatacaatgccttaaaacttgcctatgcaaatttccagtgtagaatctgaaattaattccagtttttacacatatgagaactgtcccttaattaatgataaaattaatgaccagaatattaataaagggattttgaaattgagtttcctggaaagcgtaatgttattaatgagactaacaataaagatgatatgtaagtatggatatgtttggaaatatatattttatatgtgaaagagacaggaaaaaattactgtctcataatagtaatatcagtataggacaatgccaacacattactcaaaatacatgacaaagtagaaatttaaagatgtcattttattaccttgaaaaaccccagctggggttttctttaatacaaaattaccttgtgatcatggtaattcatatctaagtgctagtgtgaatatgcctaaaatcaaatgttagtttacaaggctaactgaagaccaggtatactgaaagtcaacagcaaaaagtttttttgtactctgacttagatttaacccattaataatatttcttgtacaaaagcaagaacctatgaccaggactaatttatgcaagttttgaaaacagatatttaaaaaatgtttattttttaatactgaaatgatttatgatttatggctactccttacaaaatttactgtacatttctcattatttttatttcttttcagaacaaattccaaggatgtatatttgacctagtaacaaaccaagcatttgatatcaccatcatggttcttatctgcctcaacatggtaaccatgatggtagaaaaagagggacaaagttcatacatgactgaagttttaaactggatcaatgtggtttttattatccttttcactggagaatgtgtgctgaaactgatctccctcagacactactacttcactgtaggatggaacatttttgattttgtggttgtgattctctccattgtaggtaagaccatttattaatcagatattaattttgaatcaaactaaacatcacatgtacctggagaagtttctgagttcttgaatataaacttacttttgaatacggaaccttagaaacaaaactaaacaaaaacctctgtgtcacattacccttcatcatgttctatcacaagtgattagatatagttctctgtgctacatagcagcatctcattgcctatccactcctgatgcaacaatttgcagctactaaccccgaactcccagtccattccacttcctccgaggcaaccacaagtctcttctccaagttcatgagtttgtttcttttctgtagataggttcatttgtgccatatgttagattccagatataagtgacatcatatggtatttgtcttcctctttctgacttacttcacttagtatgagtctctagttccataaatgttgctgcaaatcgtattattttgttcttttttatggctgagtagtatcccattgtgtatatataccacttcttcttaatccattcatctgtcaacggacatttaggttgtttccatgttttggctattgtgaatagtgctgcaatgaacatatggatggatgcatgtttctttttcaatgtaagttttggccagatatatgcccaggagtgggattgcttgatatatggtagttctatatttagtttactgaggtacctccatactgttttccatagtggttgtaccaatttacagtcccaccaacagtaaaggagagtacccttttctccacatcttcctcagcatttgttatttgacttgttaatgatgcccattctgaccagagtgaggtggtacctcatagtagttttgacttgcatttctctaatagtcagtgatgttgagcacttatttgctcatgtgtctgttggccatctatatatcttctttggagaaatgtctattcaggtcttttgcccatttttcagttggcttgtttggggtttttgctgtcaagttgtataaattgtttgtatattttagagattaagcccttgtcagttgcatgatttgaaattatttatccctttctgtaggctgtctttttatttttttatggtttcctttgctgtataaaagcctgccaatttgattagaccccattgatttatttttgtttttatttttattgcctgggtgactgacctaagaaaacatttgtatggttgatgtcagagaatattttgcctatattctcttctaggagtttgatggtgtcttgtcttatgtttaagtctttaagccattttgagtttatttctgtgcatggagtgagggtgtgttttagtttcattgatttacacgcagaggtccagttttcccagcactacttgctgaaaagactttttcccattttatattcttgtctcctttgttaaaaaataattgaccatagttgtctgggtttgtttctgggttctctattctgttccattggtctgtaggtctgttttagtaccagtaccacactgcattgattactgtagctttgtaatgttgtctgaagtctgggagagttatgttccctggctgttgtttttttttttttttcccccctcaggattgctttggcaattctaagtcttttatggctccatataaacttttggattgtttgttctagttctgtgaaaaatgtcatgggtaatttgatagggattgtactgaatctgtagattgctttggatagtatggccattttaacaatattaattcttccagtccaggagtatagagtatctttccatttctttgaatcctctttaatttccttgattaatgttttatagttctcagcatatacgtctttcaccttcttggtcaggtttattcctgagcatataatttttgggggtgtgaatttaaaatgtgttttaataatcagtgaggttgagcattttctcatgtgcttgttggagaaatgcaaatcaaactaccatcaggtaccacctcacaccagtcagaatgggcatcattaataaatccacaaacaacaaatgctggaggggatgtagagaaaagggaaccctcctgcactgttggtgggaatggacactggtacaaccactatggagaacagtatggaggtacctcagaaaactatacatagaactaccatatgacccagcaatcccactcttgggcaaatatccagacaaaactttccttgaaaaagacacatgcacctgcatgttcattgcagcactattcacaatagccaaaacatggaatcaatctaagtgtccatcaacagatgaatggattaagaagtggtatatatacacaatggaatactactcagccataaaaaagaacaaagtaatgccatttgcagcaacttggatggaactagagactctcatactaagtgaagtaagtcagaaagagaaagacaaataccatatgatatcacttatatctggaatttaatatatggcacaaatgaaccttcccacagaaaagaaaatcatggactttgagaacaaatttgtggctgcctgatgggagggggagggaatgggatggactagaaattttgggttaatagatgcaaactattgcctttggaatggataagcaatgagatcctgctgtatagcactgggaactatatctagtcacttatgatggagcatgataatgtgataaaaaagaatttatgtatgtatgtgtgaatgggtcaccttgatgtacagtattaaattgacagaacactgtaaaccaggtataatggaaaaaaataaaaatcatttaaaaaaataaataaaatttaaaagtattttatttttatttctagtatttctaatatttccttgttagtatacagaaatgcaaccgatttctgaatgttaatgttgtatcctgctactttgctgaatttgttgatcagtttgagtagttttcttgtggagtccttaaggttttctatatatagtagtatcatgtcatcgcatatagtgacagttttacctcctctattctaatttggataccttttatttcttttgtttgtttgattgatgtggctaggacttccagtactatgctgaatgaatgttgtgagagtgggcatttttgtcttgttacagattttagcaggaaggctttcagcttttctccattgagtattatattggctgtgggtttgttataaatggttttcattatgttaatgtatgttccctctattcccactttggtaagagtatttattatgaatggatgtgggactttgccaaatgctttttctgcatctattgagatgatcatgtagtttttaactttcttttgttaatgtgatgtaagacgttgattgacttgcacatgttgaaccatccttgtaaacttgagaagaatcccacttggtcatgatgtatgatcttttttatatgttgttggattcgattggctaaaattttgttgagaattttttcatctatattcatcaacgatattggcctgtaattttctttcttggtagtatcttcatctggttttggtattagggtgatagtggcttcatagaatgtctttgggaatattccttcttccttaaccttttagaaaagtttaagaaagataggtataaattctttgtatgtttggtagaaattgccaaacatattgtcctggaattttgtttgtagggagtgttttattatatattcaatttcatttcttaatatcagtctgttcagtttatctatttcttcttgattcagttttggcaggctgtatatctctagaaagttgtctgtttcttctaggttgtcaaatttgttggcatataattgttcatagtatttccttttcttttcttttttttttttttttttttgtatttcttcagcatctgttgagatctctcctttttcatttcttattttgagttctttcctcttcttggagagtctggccataggtttgtcaatttgttttaccctttcaaagaaccaggtcttggttttactgattttttttctactaattttttgaatctctatttagtttatttcctctatgatatttatgatttccttccttctgctgactttaggttttatttgttctttttctaattcttttaggtggtaggttaagttgatgatttgagattcttctttttttctgaggaaggcctgtatcactgtgaacttccctctaagaatgcttttgtggcatcccatagattttgaatggttgtgttttcattatcatttgtctcgaggtattttttaacttctcttttgatttcctcattgacccattgggttttttagtagcatgctgtttagtctccatgtagtcagttttttctcatttctttccctgtggttgatttctagtttcatgccactgtggtcagacaagatacttgaaataatttctatacccttaaatttgttgaggttagttttattcccccagtatgtggtcagtccttgagaatattacatgtgcacttgaaaagaatgtttatcctgattttttggatgtaatgtcctgaaaatatcaattaagtttaagttttctattgtgttatttaagatctctgttgccttattgattttctgtctagaggatctgtccattgatatgagtggggtgttaaattctcctactattattgtattcccataaatttctccttttagatctattaatatttcttgtatgtatttgggtgctcctatattaggggcagatatattgacaagtgtaggatcctcttcctgcatggattcttttatcattaaatagtgtccttcttcatctttctttatggccttcattttaaagttgattttttctgatatgagtattacaactcatactgtcccatcttttccattggcatgaaatatcttttcccatcctctcactttctatttacatgtgtcctttgccctaaggtgagtctcttgtaggcagcatattataggttcttgtttttttaatccagtctgcctctctgtgtcttttgattggagcattcagtccattgacatttaaggtaattactgataaatatatatttagtgccattttaaacattgttttccagttgattctatgtgtctcctttgttcctttctttttttgtctggatgatttccttttattttgtttgtgtcctcttctttttgcattttgtgaatgtactgtttggttttgatttgcggtagccctatttttcaactatgttaacccctttctgtatctgcttgctttaacctgatagtcatatagactcaaacacattatttaaaaaaaaagaatctagaatttcttgtttcccttccctacattttatgatttcgatgtcctttttttaacatcttcatgtttttccttttgcttttcctggtgtttatcatcacttttacaatagttttttttttttttccccttttaggtatgtatactggcttagttgagtgattactttcaatcatgatttcctccatcctatttcttacttcttttttatttagaggagccatttcagtctttcttttagaatgggtgtagtatagctctgttcttttagtttctgtttattgttggagaaattctttatttttccttctattttaaataatattcttgctgggtagagtattctaggctgcaagtttttcccttttagaactttgaatatatctttccactctcttctggcctgtagcatttctgtagagaaatcagctgatagccttgtgggggttcccttataattaactctttgtttatctcctgctgcctttataatcctctctttttatctttaacttttgccatttttattataatatgtcttggtgtgggcctgtttgggttcaacttgtttggggccctctgtgcttcctgtatcttgatatcagtatcctttagatttggaaagttttcagccataatttcttcaaatatattttcaatctccttttccttttcttctccttctgggatccctattatatgtggatcagcttgctttatactatttcatagatctcttatattgctttcatgttttttcatttggtgttctgtctcttgtcatgattgggtaatttacattattctggttttttgtttgtttgtttgttttgctctttagggctacatccacagcatatggaggttcccaagcaaagggttgaatcaaaactacagctgccggcctatgccacagccacaacagtgccagacccaagccacatctgtgacctacaccacagctcatggcaacaccgaatccttaacccattgagcaaggccaggaattggacctgcaacctcatggttcctatcagattctttttctctgtgccacagtgggaactccgatttctattattctgtctttcaagtcaaaaatttgttcctctgccttattcattctctcctcagtactttcaactcagcttgcatctctgtaaatgaattttctagtttttctttgctcctccctctattttctagttcctttctaaagtaatcagcattattgttcatatccactcttaattccttcatgtttgctcttaatttctttagtattttcactatctcctttttgaactcggtatgagttagactacataggtgtgtttcattgtttgctccttcaagggaattctcctcttaactgagaatggttcctgagcatcttcattttgcttacatttttcttattctgtgagtttagagaaaacaactactgtagtcttgcagggctattcatatttgagagcacccctgggtattttgtgagggcttactatttatttttatcatgagagctgctttggattggatgattgctgtctcttccttcagtgtatgtaggctgtaatccccctttacagggtgctgtgtgtgcttccaggagatggaggcaatgggcagggctagtagccagtgtctggttggtgggcccttgacaatgggaagggcttgtggagaggtggtgcaggttgctcctagttgcagggcactggtaagtggcagtgaccctcaggcagatttaggtggcagaggtgactggggccacaggtggtgcctgttcacagacccctagtggtggtgagccacactcacttctggagtctgagacgactgcagtgattttcccctgctgcctatagaccatgtagtaggtgccatgtcatgcttagcccatgcaggaggtaccccgctgaccttatcccataccagagttgcccagccacccatagcccacacaagaggtggcccatcgccggtagactgcgacagaagcaccctgccctctgagagtctgcacatgagcagagaaaggtattcctatggtggtctacccctcctcctttcacccttcctagcaatggcaccttgcttctcctgtgggcccagacctcctcccgagtttccttgactgtggcactctgctccctagcccctcaggctgtctccactcagccaaccctagtcctctccccaaaactggcttctggagcctggatctcagaacccaattcccacctgagtatctcaggctgtggtgtctgggggcagtggtgctgatggtctgtgcagctctctctctctgcttttccctccttaatccagcttctgtgcttttctccaaggctttgaggtccctctgtctaggctgatcttcacatcagttaggtggcttcccagtgtgtaggttcccttcctctttaacagttccctctcaagagtgctagtcccatcctgattccttttctctctctattctttctcccccccgcctcttctgttctacccagtaatgtgaagggtttcttgcccttttggaggtttaaggtcttctgccagctttcagtagatgttctgtgtgaatcattttactggtagatttttttttttcttttgatgtatttgtgggagaaggtgaacaccacgtcttactcctttccaattttggtcccacctccaatatgaccatttttaataaattaatctataggtgttatcccagtgagagtatcaatgtccttttgtgtggtgggggtaatgctttggcaatataaatataaatgattctaaaattcatctggaagaaaaattagagtaatgaggagtgatttgcattgctggatattaagattattattatattgatgaagacaatttactaaaatactcaatggattcaaataaattatccaaacttaaactttaatatatagagaattactatgttatgcagtaatcacacaaatcacattaatcataaattaatatgtaaaaaatggattctagtgggaataggtttatatccatgaacttgaatagtcctttctattcatctgttcatgacataaacttgatcctacgaagaaaaaacaatagggttttgttttgttttgtttttgtctttttagggctgcacccacgtcatatggaggttcccaggctcagggtctaattggagctgtagccgccagcgtacaccacagccacagcaatatcagatctgagctgcgtctgagacctacacgacagctcacagcagtgccagacccttaacccactgtgtgaggtcagggattgaacttacaacctcatggttcctactcggattcatttccgctgtgccacgatgggaactccaataataggtattttttgactgcataaaaatcaaaatattctatggaggaaaactcaccaccaccaccaccacattttttttttaaaggttgaaagacaaaagatagaaaaattgttaatgtagcatttaaggctaacaggattagaacttgtaatagaaaaatagtcctcataaatcaaaaggaaaatactaaaactccgataggaaaatggctaaggactagactaggtcaaaaaaagaaagttgaaaatagccaacaaacatataaaatatccgttaagtaagaaaaaaatgtggattattttttccaaaaataaattcaaataaattataataatgagatggtttaaacatcacaaagatttgtttgtaaaattataaagaagaatgatacaactggtgagcacgtggggcatgagaacgctcatatactatcattaggagtgttaatttgcacaaactttctaaagatagatttgtaatgcactataaaattttaaatatattgtttgacctaacttctattaatgtattatcaaaatgtgcttatgcatctagaaaaaaatacatctgcttgggtattcttagccaaaacaactgtaaacaacataaaattcttcaaaatatggttactttgacaggaccttgtacaactgtaaggaattattctgctctcatttatatggggatagcttcatagcatataatgaagtaactaaaacagatgacaaaaaaagcttctataccattattatatttgtatgtgtttgtatgcttgcatagaaaaatggagtgatcctcaataaaatactaacaatagttaatggctgatatttcaggtgatttatatttcctttttagcattttatgttattgctttaatttttctaccttataattaaaaaacttgttttgaaggacaaaaaataaggtccacaaacttagtaacagagagaaaatgtcacaacggtaattctcattattttcctgtagaattgttcgaacccttttctatgaaatgctttcagtgtaaaatgacagtcctgaaatcgtaagagataatatggcacatgaaaccatacagagtcatgattttccatagcatggatatttaaatattttctttttattccttccctcttcaccaggtatgttcctagcagatttgatagaaaggtattttgtgtcccctaccctgttccgagtgatccgtcttgccaggattggccgcatcctgcgtctgatcaaaggggccaaggggatccgcacgctgctctttgctttgatgatgtccctgcctgcgctgttcaacatcggcctcctgctcttcctggtcatgttcatctacgccatctttggaatgtccaacttcgcctatgttaagaaggaagctggaattaatgacatgttcaactttgagacctttggcaacagcatgatctgcctgttccagatcaccacctctgctggctgggatggactgctagcacctattcttaatagtgcaccacctgattgtgaccccaaaaaagttcatcctggaagttcagttgaaggagactgtgggaatccatctgttgggatattctattttgtcagttacatcatcatatcatttctggtcgtggtgaatatgtacattgctgtcattctagagaatttcagtgttgctactgaagaaagtactgagcccctgagtgaggatgactttgagatgttttatgaggtttgggagaagtttgatccagatgcaacacagtttatagaatatagcaaactctctgattttgcagctgccctggatcctcctctcctcatagcaaaaccaaacaaagtacagctcattgccatggatcttcccatggttagtggagaccgaatccattgtcttgacatcttatttgcttttacaaagcgtgttttgggcgaaagtggagagatggactctcttcgttcacaaatggaagaaaggttcatgtctgcaaatccttctaaagtgtcctatgaacccatcacaactacactaaaacgaaaacaagaggatgtgtctgctactgttattcaacgtgcttacagacgttaccgcttacggaaaaatgtaaaaaatatatcgagtatatacataaaagatggagacagagatgatgatttgcgcaataaagaagatatggtttttgataacgtcaatgacaactcaagtccagaaaaaacagatgcaaccccatccaccatctccccaccttcctatgatagtgtaacgaaaccagacaaagagaaatacgaacaagacaaaacagaaaaggaagacaaagggaaagatggcaaggaagggaaaaaatagatcttcattgttgatattttgtttacagcctgtgaaggtgatatacttgtgttaataagactattttaaggaggtctatgccaaaactctttttatcaaaatattctcaaagtcagtgcagttactagctccgatttcctaacacaggtgggcagcattagcagatggctatttttgcattggcaaacgattctgtaagaattgttaagagtaactctacagggattattgattatagcaagcaaaggtgattcaattttgtttacttttaataaatcagaagaccatgtagaaaatgttgacatccgccttgtcatcttttcacaggattgtaaacattcatgttttccatgcacacacacacacacacacacacacacacacacacacactcacaaatatctatcatttctacagaagtattttgccttgactttgcaatgaaatgccctgatagaaggaatggatattgggtaatgaatgtttagttaaaatatcttattatttgggggcaagactcttttatctatgtatagaggtcattctatattttgaggtgcttaaatttattccatacttcatcaaaaccaatttacatgtgcctattaaatgtcatgggattaaaaacatatgtaggctattcagttcaacaaatactttttattcatcttaattcatgtaccagctagggcaagagttacctttagagtattgtgctccataggctgcctttttctatatccttttttgttcatataataaccatggaacatgaaaaacaattttaagtatgtatcatgttcctcaaaagaaaaaaaaatgaagataattgagggaaaaaaagctactggagaaagctttatacccttttatttatacagtgtaacactggactgtgctgtccaaaaatatcaataattgagacccaactctcaaatcatttttgtcacagttttctgctttctcatgcagtattgtttagtcattctttagcactaagcagagttgatatttctcttcaatggcatgcttccagatatgcagatagatatttgatcctacggtacatgtttgagcacataatgacttgggcacagtatttactgtatcacctgcataccatcctaaatgtgtatgacaagctttcaagtcataatacatgtcaggctttcaacacagacttgtgtatagtaaaaatgaaatagcattcaattgagattcttgccaacttgctttcctatttggtactagttatactcttcaaccaacctctattcttctacagaaagaggagtatgtcacatgctccttaaaattttatgactatgagatatattatgtatcagtcagtaacataacctgagcttataatttatgaagcacacattcattttgctttagcagttgtccttctaccaaggattataaatctggttttaaaaaattcttgataataatggcttaaaaagaggtagccatgatgcatttttttatgagtttatttcaagaatatgagatcttttgacttattcatgcacaggcaaaaattgagttacataagtagaaaataattttatttagaaaattttgtgggagtttccaaagcaaatatatataacaatatttatttattcatttgctttcttagatgaaaaataacacaaattatatttctatattaagtacttaaaacatatttttaattgttctgcctacttaaaaataaaggagttttaaacatacttatagagatggagaagtatgggaagaaaatgagagacagagaagcaaagaaatacagatatgaaaaagaccaataaaaaggtgacatttccatagtatttccttactagaacattttttaattgcgctgtgttttacaacaaccatgcaggaaatgatcacttctagacacctgtcctaaggcatgtataaaattacatctagagccaaagattctctacacctaagttcaatgatttatcttattatttgagcctcttttttatttaatatgtaagaaaccaggcagtgttttcctagactggaaaacagtcaagcattgcatcacatccctactaaatctgttggaaataggttttgacaatttaattagaaaaccatgcaaaatatattacatttgtagaattttttaatacattaaattaataaatgaatattaatttaaatatgaatgcaatttatcctcatcattttgaatccacataaatataactggactttgcatatttatataattcagtgtgaaaagatgtatagttggcaggtttatgtgtgatttactatttaatgtttttacattgcctgatttttatgtgaaaaaaaaaatactggcaactggttcctcaacacactcttcttagtgtttcaaaaaaaaagaaaaaaattacaaagtggcacttgctcctctttcatgatgaactctttttaaaaaatataacatggttatgtatggtttttcatatatgtttcccaggaatgtctagttgtgactttctatcaattaataacaatatttggaaccaagagctcatttaatacagcagaggcttgaaggaaaattagacttctcttttcatatagactactgtttggtactgattataaaatatcaccctcagaaagtactatcatgttaatatttaagtcacacaaccactgaactcattttacctaatgataaagaatggcagttacactgtaaaatttttaaatttaaaattggagtacaatggaagtgatcagatctcattttacctttttgactgttacatagtttgcaaaagatataagtgacttgtgggctgtttctaaatgctgattgttgaaaatgtcgactcaaaatattcagcatgattttatagaattttgatagctttattaaagagttaagataaaatgcatatgtaaataaagcagttctatttagcaatttcagagaaatgttaatgagagtgatgaaagaaggccagctaaattagaatggccaagtaatttgcttgggtttagggcctatgtatagagggcaccaatttgttttagtatctgcggtttattatgttatattcttgagggaaataatcaagaattactgcaaaaaatgaatagccatgaatataataatgctctttacatagaattctttacaaatttcatacatctatgaatgctcaaaatgtttgagttgtcatatactgtagttatacttgagacttacacattgtaatagaatctaaaaataaaagtcatcaaaaaataaaatcatgcttgcatatactttctgtttttgtgagactaacccttaaggagataaattcagtgcatccctaaataagttgtagctactgattgcttttttcttttttattgaaaaatggacaacttcagtgtcttccagaagtgttccaggataagaaagatgatgataaagaatatagaattccaaagggattcattaaaatccacaatagagtttgttcaggagaagaaaattgagttaggaagtgaaaatatacacacacttagccacacagtgacagtgtgtaccttcgttgtgcattttctttgtgtaaatgaagtgagaggtaggctagcatacataatagctaaaggtttcggttctagatccagaattattgggataccagttaagccagtactcttcaagtttccttactcttacattatttaacctatgtacctcagctttctcatccataaaatgaagatagggagttcccattgtggcacatggaaaatgaacctgactagtatcatgaggatacgggtttgatccctggcctcactcagtaggttaaggatccggtgttaccatgagcagtagtgtaggttg

SEQ ID NO: 4 - DNA, 180809 bp, homo sapiens
gggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaa

SEQ ID NO: 5 - DNA, 180713 bp, homo sapiens
ggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaat

SEQ ID NO: 6 - DNA, 178440 bp, homo sapiens
ggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaatta

SEQ ID NO: 7 - DNA, 6941 bp, homo sapiens
acgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaa

SEQ ID NO: 8 - DNA, 113346 bp, homo sapiens
atggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggttt

SEQ ID NO: 9 - DNA, 177304 bp, homo sapiens
agcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaac

SEQ ID NO: 10 - DNA, 113085 bp, homo sapiens
atggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatag

SEQ ID NO: 11 - DNA, 30126 bp, homo sapiens
tatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagtta

SEQ ID NO: 12 - DNA, 1897 bp, homo sapiens
gtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaa

SEQ ID NO: 13 - DNA, 98254 bp, homo sapiens
gggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcaca

SEQ ID NO: 14 - DNA, 87330 bp, homo sapiens
agtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacat

SEQ ID NO: 15 - DNA, 2916 bp, homo sapiens
ctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgc

SEQ ID NO: 16 - DNA, 73939 bp, homo sapiens
tgccctcggggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagt

SEQ ID NO: 17 - DNA, 16 bp, Artificial sequence
  Synthetic oligonucleotide
gaaaatacgatatcca

SEQ ID NO: 18 - DNA, 19 bp, Artificial sequence
  Synthetic oligonucleotide
gaagaggaattaaaatata

SEQ ID NO: 19 - DNA, 20 bp, Artificial sequence
  Synthetic oligonucleotide
gattagtgaaatttagtgaa

SEQ ID NO: 20 - DNA, 18 bp, Artificial sequence
  Synthetic oligonucleotide
tatttgtaaaagagctgt

SEQ ID NO: 21 - DNA, 20 bp, Artificial sequence
  Synthetic oligonucleotide
tggatttttttatgaatgga

SEQ ID NO: 22 - DNA, 17 bp, Artificial sequence
  Synthetic oligonucleotide
aagaggtgtttaaatca

SEQ ID NO: 23 - DNA, 19 bp, Artificial sequence
  Synthetic oligonucleotide
tgaatgagtagttatatat

SEQ ID NO: 24 - DNA, 17 bp, Artificial sequence
  Synthetic oligonucleotide
tggttgatagatcatga

SEQ ID NO: 25 - DNA, 21 bp, Artificial sequence
  Synthetic oligonucleotide
tattatggagaaatatactgt

SEQ ID NO: 26 - DNA, 19 bp, Artificial sequence
  Synthetic oligonucleotide
tggtgaatgaaaagtaaga

SEQ ID NO: 27 - DNA, 22 bp, Artificial sequence
  Synthetic oligonucleotide
gagaatatatgagaaaatagta

SEQ ID NO: 28 - DNA, 19 bp, Artificial sequence
  Synthetic oligonucleotide
gaattagaatttcaacaga

SEQ ID NO: 29 - DNA, 17 bp, Artificial sequence
  Synthetic oligonucleotide
tgtgtaaagaaaacgat

SEQ ID NO: 30 - DNA, 17 bp, Artificial sequence
  Synthetic oligonucleotide
aagagatataggatctg

SEQ ID NO: 31 - DNA, 17 bp, Artificial sequence
  Synthetic oligonucleotide
tgtaaaaaggtacttgt

SEQ ID NO: 32 - DNA, 19 bp, Artificial sequence
  Synthetic oligonucleotide
ttgggagttgataatgatt

SEQ ID NO: 33 - DNA, 18 bp, Artificial sequence
  Synthetic oligonucleotide
aatggtattaaaactgat

SEQ ID NO: 34 - DNA, 18 bp, Artificial sequence
  Synthetic oligonucleotide
tgtttacatgatggtcat

SEQ ID NO: 35 - DNA, 24 bp, Artificial sequence
  Synthetic oligonucleotide
tattttgtgatgatgtgatctatt

SEQ ID NO: 36 - DNA, 18 bp, Artificial sequence
  Synthetic oligonucleotide
atgaagttaataatggac

SEQ ID NO: 37 - DNA, 19 bp, Artificial sequence
  Synthetic oligonucleotide
taagtggttaaaataatca

SEQ ID NO: 38 - DNA, 19 bp, Artificial sequence
  Synthetic oligonucleotide
tggtgtgagagttatgttt

SEQ ID NO: 39 - DNA, 21 bp, Artificial sequence
  Synthetic oligonucleotide
tagaattaaaatttaaggaaa

SEQ ID NO: 40 - DNA, 17 bp, Artificial sequence
  Synthetic oligonucleotide
attgaaatggttaagga

SEQ ID NO: 41 - DNA, 20 bp, Artificial sequence
  Synthetic oligonucleotide
tgagaaaaaaaaataattaa

SEQ ID NO: 42 - DNA, 66 bp, Artificial sequence
  Synthetic oligonucleotide
taagaattgagaaataatgaaggttcaagatctagaggaaatttgtttgataagatattaagctgt

SEQ ID NO: 43 - DNA, 18 bp, Artificial sequence
  Synthetic oligonucleotide
tgaaatagtgatggttgt

SEQ ID NO: 44 - DNA, 21 bp, Artificial sequence
  Synthetic oligonucleotide
tatgtgtaaaatagattgtaa

SEQ ID NO: 45 - DNA, 20 bp, Artificial sequence
  Synthetic oligonucleotide
ttggtaataatgtgtgattt

SEQ ID NO: 46 - DNA, 20 bp, Artificial sequence
  Synthetic oligonucleotide
tgaattgattataaaagtaa

SEQ ID NO: 47 - DNA, 19 bp, Artificial sequence
  Synthetic oligonucleotide
tgataaatttgtaagtgaa

SEQ ID NO: 48 - DNA, 19 bp, Artificial sequence
  Synthetic oligonucleotide
gatgattgagtttaaagaa

SEQ ID NO: 49 - DNA, 18 bp, Artificial sequence
  Synthetic oligonucleotide
atgattggaaaataaaga

SEQ ID NO: 50 - DNA, 18 bp, Artificial sequence
  Synthetic oligonucleotide
atgtttactataatcaca

SEQ ID NO: 51 - DNA, 16 bp, Artificial sequence
  Synthetic oligonucleotide
ggcatatcatatatcc

SEQ ID NO: 52 - DNA, 20 bp, Artificial sequence
  Synthetic oligonucleotide
ccaattttttcttaaaatat

SEQ ID NO: 53 - DNA, 18 bp, Artificial sequence
  Synthetic oligonucleotide
tctcataaatcctcatat

SEQ ID NO: 54 - DNA, 17 bp, Artificial sequence
  Synthetic oligonucleotide
tattctacccacattct

SEQ ID NO: 55 - DNA, 17 bp, Artificial sequence
  Synthetic oligonucleotide
agtattctacccacatt

SEQ ID NO: 56 - DNA, 17 bp, Artificial sequence
  Synthetic oligonucleotide
aagtattctacccacat

SEQ ID NO: 57 - DNA, 18 bp, Artificial sequence
  Synthetic oligonucleotide
tatctcatattccacaaa

SEQ ID NO: 58 - DNA, 17 bp, Artificial sequence
  Synthetic oligonucleotide
ttatctcatattccaca

SEQ ID NO: 59 - DNA, 17 bp, Artificial sequence
  Synthetic oligonucleotide
gttatctcatattccac

SEQ ID NO: 60 - DNA, 18 bp, Artificial sequence
  Synthetic oligonucleotide
ttcaatgaagaaatttca

SEQ ID NO: 61 - DNA, 19 bp, Artificial sequence
  Synthetic oligonucleotide
gctcaattttccaattatt

SEQ ID NO: 62 - DNA, 20 bp, Artificial sequence
  Synthetic oligonucleotide
tctaatcttatttatctttc

SEQ ID NO: 63 - DNA, 18 bp, Artificial sequence
  Synthetic oligonucleotide
tcccataatatttaccta

SEQ ID NO: 64 - DNA, 20 bp, Artificial sequence
  Synthetic oligonucleotide
atcacttcaactttataata

SEQ ID NO: 65 - DNA, 18 bp, Artificial sequence
  Synthetic oligonucleotide
ttcatcacttcaacttta

SEQ ID NO: 66 - DNA, 16 bp, Artificial sequence
  Synthetic oligonucleotide
tcctacctgaattacc

SEQ ID NO: 67 - DNA, 17 bp, Artificial sequence
  Synthetic oligonucleotide
gcttttaacactttata

SEQ ID NO: 68 - DNA, 20 bp, Artificial sequence
  Synthetic oligonucleotide
ctcctaatatataatatact

SEQ ID NO: 69 - DNA, 19 bp, Artificial sequence
  Synthetic oligonucleotide
tctcctaatatataatata

SEQ ID NO: 70 - DNA, 19 bp, Artificial sequence
  Synthetic oligonucleotide
atatatctcctaatatata

SEQ ID NO: 71 - DNA, 19 bp, Artificial sequence
  Synthetic oligonucleotide
acatatatatctcctaata

SEQ ID NO: 72 - DNA, 18 bp, Artificial sequence
  Synthetic oligonucleotide
ctcatatctacttatcat

SEQ ID NO: 73 - DNA, 19 bp, Artificial sequence
  Synthetic oligonucleotide
tactcatatctacttatca

SEQ ID NO: 74 - DNA, 18 bp, Artificial sequence
  Synthetic oligonucleotide
tctactcatatctactta

SEQ ID NO: 75 - DNA, 19 bp, Artificial sequence
  Synthetic oligonucleotide
acatctactcatatctact

SEQ ID NO: 76 - DNA, 17 bp, Artificial sequence
  Synthetic oligonucleotide
aattacaccattcctct

SEQ ID NO: 77 - DNA, 18 bp, Artificial sequence
  Synthetic oligonucleotide
cccttttaattacaccat

SEQ ID NO: 78 - DNA, 19 bp, Artificial sequence
  Synthetic oligonucleotide
acactattatacattccca

SEQ ID NO: 79 - DNA, 18 bp, Artificial sequence
  Synthetic oligonucleotide
agctacactattatacat

SEQ ID NO: 80 - DNA, 20 bp, Artificial sequence
  Synthetic oligonucleotide
acttccatattattttccat

SEQ ID NO: 81 - DNA, 20 bp, Artificial sequence
  Synthetic oligonucleotide
tctccttaaatacatcaaat

SEQ ID NO: 82 - DNA, 16 bp, Artificial sequence
  Synthetic oligonucleotide
atattactgtactccc

SEQ ID NO: 83 - DNA, 19 bp, Artificial sequence
  Synthetic oligonucleotide
atatttatacaacaactca

SEQ ID NO: 84 - DNA, 17 bp, Artificial sequence
  Synthetic oligonucleotide
tagtcaccatttttcat

SEQ ID NO: 85 - DNA, 19 bp, Artificial sequence
  Synthetic oligonucleotide
agaaaataattcctatcct

SEQ ID NO: 86 - DNA, 17 bp, Artificial sequence
  Synthetic oligonucleotide
atacatgtatccacttc

SEQ ID NO: 87 - DNA, 18 bp, Artificial sequence
  Synthetic oligonucleotide
ttccaatattattataca

SEQ ID NO: 88 - DNA, 19 bp, Artificial sequence
  Synthetic oligonucleotide
acccttatttaaataatta

SEQ ID NO: 89 - DNA, 18 bp, Artificial sequence
  Synthetic oligonucleotide
tcacgttaaatcccatct

SEQ ID NO: 90 - DNA, 15 bp, Artificial sequence
  Synthetic oligonucleotide
acgttaaatcccatc

SEQ ID NO: 91 - DNA, 16 bp, Artificial sequence
  Synthetic oligonucleotide
ttcacgttaaatccca

SEQ ID NO: 92 - DNA, 16 bp, Artificial sequence
  Synthetic oligonucleotide
ggatatcgtattttct

SEQ ID NO: 93 - DNA, 15 bp, Artificial sequence
  Synthetic oligonucleotide
tctggatatcgtatt

SEQ ID NO: 94 - DNA, 18 bp, Artificial sequence
  Synthetic oligonucleotide
gatatattatccatctca

SEQ ID NO: 95 - DNA, 17 bp, Artificial sequence
  Synthetic oligonucleotide
tgatatattatccatct

SEQ ID NO: 96 - DNA, 18 bp, Artificial sequence
  Synthetic oligonucleotide
agcatctacattttaatt

SEQ ID NO: 97 - DNA, 20 bp, Artificial sequence
  Synthetic oligonucleotide
tcttaattcttatcatttta

SEQ ID NO: 98 - DNA, 19 bp, Artificial sequence
  Synthetic oligonucleotide
aacttcttaattcttatca

SEQ ID NO: 99 - DNA, 19 bp, Artificial sequence
  Synthetic oligonucleotide
tacaataattatcttctca

SEQ ID NO: 100 - DNA, 17 bp, Artificial sequence
  Synthetic oligonucleotide
tgcaaataataccctat

SEQ ID NO: 101 - DNA, 20 bp, Artificial sequence
  Synthetic oligonucleotide
ctctattctaaataaacctt

SEQ ID NO: 102 - DNA, 19 bp, Artificial sequence
  Synthetic oligonucleotide
actctattctaaataaacc

SEQ ID NO: 103 - DNA, 18 bp, Artificial sequence
  Synthetic oligonucleotide
atgactctattctaaata

SEQ ID NO: 104 - DNA, 18 bp, Artificial sequence
  Synthetic oligonucleotide
taagcatatattttccca

SEQ ID NO: 105 - DNA, 19 bp, Artificial sequence
  Synthetic oligonucleotide
tcatttccattaaatccaa

SEQ ID NO: 106 - DNA, 19 bp, Artificial sequence
  Synthetic oligonucleotide
tttcatttccattaaatcc

SEQ ID NO: 107 - DNA, 17 bp, Artificial sequence
  Synthetic oligonucleotide
ttttatcctacttctac

SEQ ID NO: 108 - DNA, 18 bp, Artificial sequence
  Synthetic oligonucleotide
tccctcaaatataaattc

SEQ ID NO: 109 - DNA, 17 bp, Artificial sequence
  Synthetic oligonucleotide
actgttttctctaaacc

SEQ ID NO: 110 - DNA, 16 bp, Artificial sequence
  Synthetic oligonucleotide
agattcactacatcca

SEQ ID NO: 111 - DNA, 20 bp, Artificial sequence
  Synthetic oligonucleotide
gcactctgattacatttcct

SEQ ID NO: 112 - DNA, 20 bp, Artificial sequence
  Synthetic oligonucleotide
tatttaatcactttatctaa

SEQ ID NO: 113 - DNA, 19 bp, Artificial sequence
  Synthetic oligonucleotide
atatttaatcactttatct

SEQ ID NO: 114 - DNA, 20 bp, Artificial sequence
  Synthetic oligonucleotide
atcaaccacacaattacttt

SEQ ID NO: 115 - DNA, 20 bp, Artificial sequence
  Synthetic oligonucleotide
tatcaaccacacaattactt

SEQ ID NO: 116 - DNA, 19 bp, Artificial sequence
  Synthetic oligonucleotide
ttatcaaccacacaattac

SEQ ID NO: 117 - DNA, 20 bp, Artificial sequence
  Synthetic oligonucleotide
tcaataaaattccttatact

SEQ ID NO: 118 - DNA, 20 bp, Artificial sequence
  Synthetic oligonucleotide
tcattttatttatttcaatt

SEQ ID NO: 119 - DNA, 20 bp, Artificial sequence
  Synthetic oligonucleotide
tatacactctttctctattc

SEQ ID NO: 120 - DNA, 17 bp, Artificial sequence
  Synthetic oligonucleotide
tgaccatcttattcatc

SEQ ID NO: 121 - DNA, 17 bp, Artificial sequence
  Synthetic oligonucleotide
cctgatactcattccca

SEQ ID NO: 122 - DNA, 19 bp, Artificial sequence
  Synthetic oligonucleotide
tttctctttatcttttatc

SEQ ID NO: 123 - DNA, 17 bp, Artificial sequence
  Synthetic oligonucleotide
aaatcaaccctaaaccc

SEQ ID NO: 124 - DNA, 18 bp, Artificial sequence
  Synthetic oligonucleotide
aaagtaccatttactccc

SEQ ID NO: 125 - DNA, 19 bp, Artificial sequence
  Synthetic oligonucleotide
ttcatatactcttatttta

SEQ ID NO: 126 - DNA, 20 bp, Artificial sequence
  Synthetic oligonucleotide
ctaatttttcatatactctt

SEQ ID NO: 127 - DNA, 19 bp, Artificial sequence
  Synthetic oligonucleotide
tctaatttttcatatactc

SEQ ID NO: 128 - DNA, 19 bp, Artificial sequence
  Synthetic oligonucleotide
ctctaatttttcatatact

SEQ ID NO: 129 - DNA, 19 bp, Artificial sequence
  Synthetic oligonucleotide
acatttttcctacaaacta

SEQ ID NO: 130 - DNA, 19 bp, Artificial sequence
  Synthetic oligonucleotide
ctactattccatcattttt

SEQ ID NO: 131 - DNA, 19 bp, Artificial sequence
  Synthetic oligonucleotide
caattacacctacaacttc

SEQ ID NO: 132 - DNA, 18 bp, Artificial sequence
  Synthetic oligonucleotide
tccaattacacctacaac

SEQ ID NO: 133 - DNA, 19 bp, Artificial sequence
  Synthetic oligonucleotide
gccttaatcaatttctcaa

SEQ ID NO: 134 - DNA, 17 bp, Artificial sequence
  Synthetic oligonucleotide
cactttccaatattact

SEQ ID NO: 135 - DNA, 19 bp, Artificial sequence
  Synthetic oligonucleotide
ttacactttccaatattac

SEQ ID NO: 136 - DNA, 20 bp, Artificial sequence
  Synthetic oligonucleotide
cattacactttccaatatta

SEQ ID NO: 137 - DNA, 18 bp, Artificial sequence
  Synthetic oligonucleotide
acattacactttccaata

SEQ ID NO: 138 - DNA, 19 bp, Artificial sequence
  Synthetic oligonucleotide
atataccccaattactcca

SEQ ID NO: 139 - DNA, 17 bp, Artificial sequence
  Synthetic oligonucleotide
atactagcaattcatca

SEQ ID NO: 140 - DNA, 18 bp, Artificial sequence
  Synthetic oligonucleotide
ataccattaactatcacc

SEQ ID NO: 141 - DNA, 18 bp, Artificial sequence
  Synthetic oligonucleotide
agataccattaactatca

SEQ ID NO: 142 - DNA, 18 bp, Artificial sequence
  Synthetic oligonucleotide
cccatcttcattatatta

SEQ ID NO: 143 - DNA, 17 bp, Artificial sequence
  Synthetic oligonucleotide
ttctgatctctcttata

SEQ ID NO: 144 - DNA, 18 bp, Artificial sequence
  Synthetic oligonucleotide
atttcattcaggaaatac

SEQ ID NO: 145 - DNA, 20 bp, Artificial sequence
  Synthetic oligonucleotide
tcatttcatcaataacatta

SEQ ID NO: 146 - DNA, 17 bp, Artificial sequence
  Synthetic oligonucleotide
ttgcttttttactaaca

SEQ ID NO: 147 - DNA, 18 bp, Artificial sequence
  Synthetic oligonucleotide
gtttcatttctttattat

SEQ ID NO: 148 - DNA, 17 bp, Artificial sequence
  Synthetic oligonucleotide
gctattatattactttt

SEQ ID NO: 149 - DNA, 19 bp, Artificial sequence
  Synthetic oligonucleotide
gtcctctaatcatatcaca

SEQ ID NO: 150 - DNA, 18 bp, Artificial sequence
  Synthetic oligonucleotide
tagtcctctaatcatatc

SEQ ID NO: 151 - DNA, 17 bp, Artificial sequence
  Synthetic oligonucleotide
ttagtcctctaatcata

SEQ ID NO: 152 - DNA, 17 bp, Artificial sequence
  Synthetic oligonucleotide
acttagtcctctaatca

SEQ ID NO: 153 - DNA, 18 bp, Artificial sequence
  Synthetic oligonucleotide
taaataaaacaatcccca

SEQ ID NO: 154 - DNA, 20 bp, Artificial sequence
  Synthetic oligonucleotide
taattaaataaaacaatccc

SEQ ID NO: 155 - DNA, 18 bp, Artificial sequence
  Synthetic oligonucleotide
atacatacctctattatt

SEQ ID NO: 156 - DNA, 19 bp, Artificial sequence
  Synthetic oligonucleotide
tcaatacatacctctatta

SEQ ID NO: 157 - DNA, 19 bp, Artificial sequence
  Synthetic oligonucleotide
ctcaatacatacctctatt

SEQ ID NO: 158 - DNA, 18 bp, Artificial sequence
  Synthetic oligonucleotide
gaactcaatacatacctc

SEQ ID NO: 159 - DNA, 17 bp, Artificial sequence
  Synthetic oligonucleotide
agaactcaatacatacc

SEQ ID NO: 160 - DNA, 18 bp, Artificial sequence
  Synthetic oligonucleotide
tgaatttttattcccttc

SEQ ID NO: 161 - DNA, 18 bp, Artificial sequence
  Synthetic oligonucleotide
acacaataccatatttca

SEQ ID NO: 162 - DNA, 18 bp, Artificial sequence
  Synthetic oligonucleotide
tgctataatattttatct

SEQ ID NO: 163 - DNA, 19 bp, Artificial sequence
  Synthetic oligonucleotide
acaaactttcaatactcta

SEQ ID NO: 164 - DNA, 18 bp, Artificial sequence
  Synthetic oligonucleotide
tcttctacactattattc

SEQ ID NO: 165 - DNA, 20 bp, Artificial sequence
  Synthetic oligonucleotide
atatcttctacactattatt

SEQ ID NO: 166 - DNA, 19 bp, Artificial sequence
  Synthetic oligonucleotide
tatatcttctacactatta

SEQ ID NO: 167 - DNA, 17 bp, Artificial sequence
  Synthetic oligonucleotide
ttatatcttctacacta

SEQ ID NO: 168 - DNA, 17 bp, Artificial sequence
  Synthetic oligonucleotide
agctcattttcctatac

SEQ ID NO: 169 - DNA, 19 bp, Artificial sequence
  Synthetic oligonucleotide
tacttttttttctatccaa

SEQ ID NO: 170 - DNA, 18 bp, Artificial sequence
  Synthetic oligonucleotide
tctacttttttttctatc

SEQ ID NO: 171 - DNA, 18 bp, Artificial sequence
  Synthetic oligonucleotide
tttattaatttactcctt

SEQ ID NO: 172 - DNA, 18 bp, Artificial sequence
  Synthetic oligonucleotide
attttattaatttactcc

SEQ ID NO: 173 - DNA, 19 bp, Artificial sequence
  Synthetic oligonucleotide
accaataccataaattcca

SEQ ID NO: 174 - DNA, 19 bp, Artificial sequence
  Synthetic oligonucleotide
attaatattttttctccat

SEQ ID NO: 175 - DNA, 20 bp, Artificial sequence
  Synthetic oligonucleotide
tttattaatattttttctcc

SEQ ID NO: 176 - DNA, 20 bp, Artificial sequence
  Synthetic oligonucleotide
tccttttattaatatttttt

SEQ ID NO: 177 - DNA, 18 bp, Artificial sequence
  Synthetic oligonucleotide
cctccttttattaatatt

SEQ ID NO: 178 - DNA, 18 bp, Artificial sequence
  Synthetic oligonucleotide
gcctccttttattaatat

SEQ ID NO: 179 - DNA, 18 bp, Artificial sequence
  Synthetic oligonucleotide
taacatatctaccatctc

SEQ ID NO: 180 - DNA, 17 bp, Artificial sequence
  Synthetic oligonucleotide
aatcccttaccattatt

SEQ ID NO: 181 - DNA, 17 bp, Artificial sequence
  Synthetic oligonucleotide
acagcttcatttaacta

SEQ ID NO: 182 - DNA, 19 bp, Artificial sequence
  Synthetic oligonucleotide
ttaaccaaatctatacact

SEQ ID NO: 183 - DNA, 17 bp, Artificial sequence
  Synthetic oligonucleotide
ttagactaaccatccta

SEQ ID NO: 184 - DNA, 17 bp, Artificial sequence
  Synthetic oligonucleotide
tattagactaaccatcc

SEQ ID NO: 185 - DNA, 17 bp, Artificial sequence
  Synthetic oligonucleotide
acctcataatacttttc

SEQ ID NO: 186 - DNA, 17 bp, Artificial sequence
  Synthetic oligonucleotide
tacctgataacatcttt

SEQ ID NO: 187 - DNA, 18 bp, Artificial sequence
  Synthetic oligonucleotide
ttactaatctaaatacct

SEQ ID NO: 188 - DNA, 18 bp, Artificial sequence
  Synthetic oligonucleotide
tctcattttactaatcta

SEQ ID NO: 189 - DNA, 18 bp, Artificial sequence
  Synthetic oligonucleotide
ttctcattttactaatct

SEQ ID NO: 190 - DNA, 17 bp, Artificial sequence
  Synthetic oligonucleotide
aaccaagtctatatcca

SEQ ID NO: 191 - DNA, 18 bp, Artificial sequence
  Synthetic oligonucleotide
tcaccttcataacttatc

SEQ ID NO: 192 - DNA, 20 bp, Artificial sequence
  Synthetic oligonucleotide
attttaaattactctcctat

SEQ ID NO: 193 - DNA, 20 bp, Artificial sequence
  Synthetic oligonucleotide
atattttaaattactctcct

SEQ ID NO: 194 - DNA, 18 bp, Artificial sequence
  Synthetic oligonucleotide
agtacaatttaactccct

SEQ ID NO: 195 - DNA, 19 bp, Artificial sequence
  Synthetic oligonucleotide
attatctataatataccta

SEQ ID NO: 196 - DNA, 18 bp, Artificial sequence
  Synthetic oligonucleotide
tccataaatctattccaa

SEQ ID NO: 197 - DNA, 18 bp, Artificial sequence
  Synthetic oligonucleotide
ttccataaatctattcca

SEQ ID NO: 198 - DNA, 18 bp, Artificial sequence
  Synthetic oligonucleotide
tttccataaatctattcc

SEQ ID NO: 199 - DNA, 19 bp, Artificial sequence
  Synthetic oligonucleotide
agcaaataaattccaacac

SEQ ID NO: 200 - DNA, 17 bp, Artificial sequence
  Synthetic oligonucleotide
tcatgcttccataatta

SEQ ID NO: 201 - DNA, 18 bp, Artificial sequence
  Synthetic oligonucleotide
cctttcccattacaattt

SEQ ID NO: 202 - DNA, 17 bp, Artificial sequence
  Synthetic oligonucleotide
acatgatacttaatacc

SEQ ID NO: 203 - DNA, 18 bp, Artificial sequence
  Synthetic oligonucleotide
caacaatatcaatcttcc

SEQ ID NO: 204 - DNA, 20 bp, Artificial sequence
  Synthetic oligonucleotide
ttattaatatttcttcttca

SEQ ID NO: 205 - DNA, 17 bp, Artificial sequence
  Synthetic oligonucleotide
tcagttaatcatctcac

SEQ ID NO: 206 - DNA, 17 bp, Artificial sequence
  Synthetic oligonucleotide
ttgccattaaaatttcc

SEQ ID NO: 207 - DNA, 17 bp, Artificial sequence
  Synthetic oligonucleotide
gatgaacagaccaaact

SEQ ID NO: 208 - DNA, 18 bp, Artificial sequence
  Synthetic oligonucleotide
atccatacatcctaaaat

SEQ ID NO: 209 - DNA, 17 bp, Artificial sequence
  Synthetic oligonucleotide
ctcatccatacatccta

SEQ ID NO: 210 - DNA, 18 bp, Artificial sequence
  Synthetic oligonucleotide
gtccaaatatcatatcat

SEQ ID NO: 211 - DNA, 17 bp, Artificial sequence
  Synthetic oligonucleotide
tgtccaaatatcatatc

SEQ ID NO: 212 - DNA, 17 bp, Artificial sequence
  Synthetic oligonucleotide
accattaatctcatatt

SEQ ID NO: 213 - DNA, 18 bp, Artificial sequence
  Synthetic oligonucleotide
tcaccattaatctcatat

SEQ ID NO: 214 - DNA, 16 bp, Artificial sequence
  Synthetic oligonucleotide
caccattaatctcata

SEQ ID NO: 215 - DNA, 20 bp, Artificial sequence
  Synthetic oligonucleotide
atcaatcaatatttattctt

SEQ ID NO: 216 - DNA, 20 bp, Artificial sequence
  Synthetic oligonucleotide
atactttacttttcaaattt

SEQ ID NO: 217 - DNA, 20 bp, Artificial sequence
  Synthetic oligonucleotide
tatactttacttttcaaatt

SEQ ID NO: 218 - DNA, 20 bp, Artificial sequence
  Synthetic oligonucleotide
ctttatactttacttttcaa

SEQ ID NO: 219 - DNA, 20 bp, Artificial sequence
  Synthetic oligonucleotide
tctttatactttacttttca

SEQ ID NO: 220 - DNA, 17 bp, Artificial sequence
  Synthetic oligonucleotide
ccaatattcctattctc

SEQ ID NO: 221 - DNA, 19 bp, Artificial sequence
  Synthetic oligonucleotide
tgtaaccactcttatcaat

SEQ ID NO: 222 - DNA, 18 bp, Artificial sequence
  Synthetic oligonucleotide
aatgtaaccactcttatc

SEQ ID NO: 223 - DNA, 18 bp, Artificial sequence
  Synthetic oligonucleotide
ttccaatttcctattaat

SEQ ID NO: 224 - DNA, 18 bp, Artificial sequence
  Synthetic oligonucleotide
cattccaatttcctatta

SEQ ID NO: 225 - DNA, 19 bp, Artificial sequence
  Synthetic oligonucleotide
aaattttcctaaattcccc

SEQ ID NO: 226 - DNA, 18 bp, Artificial sequence
  Synthetic oligonucleotide
ttcactaatctcaattta

SEQ ID NO: 227 - DNA, 20 bp, Artificial sequence
  Synthetic oligonucleotide
actaaatttcactaatctca

SEQ ID NO: 228 - DNA, 19 bp, Artificial sequence
  Synthetic oligonucleotide
ttattcactaaatttcact

SEQ ID NO: 229 - DNA, 18 bp, Artificial sequence
  Synthetic oligonucleotide
tgctaaacaattatacta

SEQ ID NO: 230 - DNA, 20 bp, Artificial sequence
  Synthetic oligonucleotide
aattattcatccattctttc

SEQ ID NO: 231 - DNA, 20 bp, Artificial sequence
  Synthetic oligonucleotide
atcaatttttcacatcaata

SEQ ID NO: 232 - DNA, 16 bp, Artificial sequence
  Synthetic oligonucleotide
ttatacccacttactc

SEQ ID NO: 233 - DNA, 18 bp, Artificial sequence
  Synthetic oligonucleotide
gtacttatacccacttac

SEQ ID NO: 234 - DNA, 18 bp, Artificial sequence
  Synthetic oligonucleotide
atgtacttatacccactt

SEQ ID NO: 235 - DNA, 16 bp, Artificial sequence
  Synthetic oligonucleotide
tgtacttatacccact

SEQ ID NO: 236 - DNA, 18 bp, Artificial sequence
  Synthetic oligonucleotide
aaatgtacttatacccac

SEQ ID NO: 237 - DNA, 19 bp, Artificial sequence
  Synthetic oligonucleotide
catctaatttttctaatct

SEQ ID NO: 238 - DNA, 18 bp, Artificial sequence
  Synthetic oligonucleotide
ttataaaacatacaccca

SEQ ID NO: 239 - DNA, 18 bp, Artificial sequence
  Synthetic oligonucleotide
attataaaacatacaccc

SEQ ID NO: 240 - DNA, 19 bp, Artificial sequence
  Synthetic oligonucleotide
cttctatcaaaaattcacc

SEQ ID NO: 241 - DNA, 17 bp, Artificial sequence
  Synthetic oligonucleotide
caaaagtatatattcca

SEQ ID NO: 242 - DNA, 17 bp, Artificial sequence
  Synthetic oligonucleotide
tacgcaaaaacaatgac

SEQ ID NO: 243 - DNA, 16 bp, Artificial sequence
  Synthetic oligonucleotide
ttacgcaaaaacaatg

SEQ ID NO: 244 - DNA, 16 bp, Artificial sequence
  Synthetic oligonucleotide
tacttacgcaaaaaca

SEQ ID NO: 245 - DNA, 18 bp, Artificial sequence
  Synthetic oligonucleotide
cagctcttttacaaatat

SEQ ID NO: 246 - DNA, 16 bp, Artificial sequence
  Synthetic oligonucleotide
tctatgatacttacct

SEQ ID NO: 247 - DNA, 19 bp, Artificial sequence
  Synthetic oligonucleotide
acaccaattacttcttacc

SEQ ID NO: 248 - DNA, 19 bp, Artificial sequence
  Synthetic oligonucleotide
cacaccaattacttcttac

SEQ ID NO: 249 - DNA, 20 bp, Artificial sequence
  Synthetic oligonucleotide
ttcacaccaattacttctta

SEQ ID NO: 250 - DNA, 19 bp, Artificial sequence
  Synthetic oligonucleotide
gcttcacaccaattacttc

SEQ ID NO: 251 - DNA, 16 bp, Artificial sequence
  Synthetic oligonucleotide
cctaatgcttcacacc

SEQ ID NO: 252 - DNA, 17 bp, Artificial sequence
  Synthetic oligonucleotide
acaactcccaaatagtt

SEQ ID NO: 253 - DNA, 18 bp, Artificial sequence
  Synthetic oligonucleotide
aaatttaattaaaattgc

SEQ ID NO: 254 - DNA, 18 bp, Artificial sequence
  Synthetic oligonucleotide
atgcattatatcaaatca

SEQ ID NO: 255 - DNA, 18 bp, Artificial sequence
  Synthetic oligonucleotide
aaaacacaagctttccta

SEQ ID NO: 256 - DNA, 17 bp, Artificial sequence
  Synthetic oligonucleotide
tcatccaatattcatca

SEQ ID NO: 257 - DNA, 20 bp, Artificial sequence
  Synthetic oligonucleotide
atattactttttattatcta

SEQ ID NO: 258 - DNA, 19 bp, Artificial sequence
  Synthetic oligonucleotide
gctaaattcctcatcaaat

SEQ ID NO: 259 - DNA, 19 bp, Artificial sequence
  Synthetic oligonucleotide
tgctaaattcctcatcaaa

SEQ ID NO: 260 - DNA, 20 bp, Artificial sequence
  Synthetic oligonucleotide
atatgctaaattcctcatca

SEQ ID NO: 261 - DNA, 17 bp, Artificial sequence
  Synthetic oligonucleotide
atgctaaattcctcatc

SEQ ID NO: 262 - DNA, 17 bp, Artificial sequence
  Synthetic oligonucleotide
tatgctaaattcctcat

SEQ ID NO: 263 - DNA, 19 bp, Artificial sequence
  Synthetic oligonucleotide
gaaaatatgctaaattcct

SEQ ID NO: 264 - DNA, 17 bp, Artificial sequence
  Synthetic oligonucleotide
tgcaatctaacttcata

SEQ ID NO: 265 - DNA, 18 bp, Artificial sequence
  Synthetic oligonucleotide
cttgatttaaacacctct

SEQ ID NO: 266 - DNA, 17 bp, Artificial sequence
  Synthetic oligonucleotide
acttgatttaaacacct

SEQ ID NO: 267 - DNA, 18 bp, Artificial sequence
  Synthetic oligonucleotide
gcttcttactatctttta

SEQ ID NO: 268 - DNA, 18 bp, Artificial sequence
  Synthetic oligonucleotide
gtcttctttaatccatca

SEQ ID NO: 269 - DNA, 19 bp, Artificial sequence
  Synthetic oligonucleotide
ctatattatatatccacct

SEQ ID NO: 270 - DNA, 19 bp, Artificial sequence
  Synthetic oligonucleotide
ctctatattatatatccac

SEQ ID NO: 271 - DNA, 19 bp, Artificial sequence
  Synthetic oligonucleotide
tctctatattatatatcca

SEQ ID NO: 272 - DNA, 20 bp, Artificial sequence
  Synthetic oligonucleotide
attctctatattatatatcc

SEQ ID NO: 273 - DNA, 19 bp, Artificial sequence
  Synthetic oligonucleotide
ccaattctctatattatat

SEQ ID NO: 274 - DNA, 19 bp, Artificial sequence
  Synthetic oligonucleotide
tccaattctctatattata

SEQ ID NO: 275 - DNA, 20 bp, Artificial sequence
  Synthetic oligonucleotide
tctccaattctctatattat

SEQ ID NO: 276 - DNA, 20 bp, Artificial sequence
  Synthetic oligonucleotide
atctccaattctctatatta

SEQ ID NO: 277 - DNA, 20 bp, Artificial sequence
  Synthetic oligonucleotide
aatctccaattctctatatt

SEQ ID NO: 278 - DNA, 20 bp, Artificial sequence
  Synthetic oligonucleotide
taaatctccaattctctata

SEQ ID NO: 279 - DNA, 19 bp, Artificial sequence
  Synthetic oligonucleotide
gaatttatctccaaactca

SEQ ID NO: 280 - DNA, 17 bp, Artificial sequence
  Synthetic oligonucleotide
tgtctacacatattacc

SEQ ID NO: 281 - DNA, 16 bp, Artificial sequence
  Synthetic oligonucleotide
tgatcccatcttatac

SEQ ID NO: 282 - DNA, 18 bp, Artificial sequence
  Synthetic oligonucleotide
tatatttctccataatac

SEQ ID NO: 283 - DNA, 18 bp, Artificial sequence
  Synthetic oligonucleotide
tattcctcaataaaccta

SEQ ID NO: 284 - DNA, 18 bp, Artificial sequence
  Synthetic oligonucleotide
gacttcctattttactca

SEQ ID NO: 285 - DNA, 18 bp, Artificial sequence
  Synthetic oligonucleotide
tttctcatatattctccc

SEQ ID NO: 286 - DNA, 18 bp, Artificial sequence
  Synthetic oligonucleotide
ttttctcatatattctcc

SEQ ID NO: 287 - DNA, 19 bp, Artificial sequence
  Synthetic oligonucleotide
ctattttctcatatattct

SEQ ID NO: 288 - DNA, 20 bp, Artificial sequence
  Synthetic oligonucleotide
tttactattttctcatatat

SEQ ID NO: 289 - DNA, 18 bp, Artificial sequence
  Synthetic oligonucleotide
ttactattttctcatata

SEQ ID NO: 290 - DNA, 19 bp, Artificial sequence
  Synthetic oligonucleotide
aacaaatattacataccct

SEQ ID NO: 291 - DNA, 18 bp, Artificial sequence
  Synthetic oligonucleotide
tgccattaaataaataca

SEQ ID NO: 292 - DNA, 19 bp, Artificial sequence
  Synthetic oligonucleotide
tgccattcaaaaatacaat

SEQ ID NO: 293 - DNA, 20 bp, Artificial sequence
  Synthetic oligonucleotide
taatatacttttatcataca

SEQ ID NO: 294 - DNA, 19 bp, Artificial sequence
  Synthetic oligonucleotide
attactttattcatctcat

SEQ ID NO: 295 - DNA, 20 bp, Artificial sequence
  Synthetic oligonucleotide
taattactttattcatctca

SEQ ID NO: 296 - DNA, 20 bp, Artificial sequence
  Synthetic oligonucleotide
ttaattactttattcatctc

SEQ ID NO: 297 - DNA, 20 bp, Artificial sequence
  Synthetic oligonucleotide
tttaattactttattcatct

SEQ ID NO: 298 - DNA, 20 bp, Artificial sequence
  Synthetic oligonucleotide
atttaattactttattcatc

SEQ ID NO: 299 - DNA, 20 bp, Artificial sequence
  Synthetic oligonucleotide
ttctatcttttctttcttta

SEQ ID NO: 300 - DNA, 18 bp, Artificial sequence
  Synthetic oligonucleotide
catgcattttttcctaca

SEQ ID NO: 301 - DNA, 18 bp, Artificial sequence
  Synthetic oligonucleotide
gaaattctaattctttct

SEQ ID NO: 302 - DNA, 18 bp, Artificial sequence
  Synthetic oligonucleotide
aacatctgttgaaattct

SEQ ID NO: 303 - DNA, 20 bp, Artificial sequence
  Synthetic oligonucleotide
atttaatccatcattattct

SEQ ID NO: 304 - DNA, 19 bp, Artificial sequence
  Synthetic oligonucleotide
taactccatatcatcaata

SEQ ID NO: 305 - DNA, 19 bp, Artificial sequence
  Synthetic oligonucleotide
attaactccatatcatcaa

SEQ ID NO: 306 - DNA, 19 bp, Artificial sequence
  Synthetic oligonucleotide
aattaactccatatcatca

SEQ ID NO: 307 - DNA, 19 bp, Artificial sequence
  Synthetic oligonucleotide
tttacctaaaatcatacca

SEQ ID NO: 308 - DNA, 17 bp, Artificial sequence
  Synthetic oligonucleotide
ttatatatcaatcccca

SEQ ID NO: 309 - DNA, 18 bp, Artificial sequence
  Synthetic oligonucleotide
ttttatatatcaatcccc

SEQ ID NO: 310 - DNA, 18 bp, Artificial sequence
  Synthetic oligonucleotide
tttttatatatcaatccc

SEQ ID NO: 311 - DNA, 17 bp, Artificial sequence
  Synthetic oligonucleotide
ctaaaaagacttgttct

SEQ ID NO: 312 - DNA, 17 bp, Artificial sequence
  Synthetic oligonucleotide
actaaaaagacttgttc

SEQ ID NO: 313 - DNA, 17 bp, Artificial sequence
  Synthetic oligonucleotide
ccttatctattatcacc

SEQ ID NO: 314 - DNA, 17 bp, Artificial sequence
  Synthetic oligonucleotide
gccttatctattatcac

SEQ ID NO: 315 - DNA, 17 bp, Artificial sequence
  Synthetic oligonucleotide
ttgccttatctattatc

SEQ ID NO: 316 - DNA, 17 bp, Artificial sequence
  Synthetic oligonucleotide
tccttacgctgtcatca

SEQ ID NO: 317 - DNA, 19 bp, Artificial sequence
  Synthetic oligonucleotide
taatccaaatttcttcata

SEQ ID NO: 318 - DNA, 16 bp, Artificial sequence
  Synthetic oligonucleotide
ctttcaagcctaatca

SEQ ID NO: 319 - DNA, 18 bp, Artificial sequence
  Synthetic oligonucleotide
tgttttcatataaaccat

SEQ ID NO: 320 - DNA, 19 bp, Artificial sequence
  Synthetic oligonucleotide
gattattacataccttcca

SEQ ID NO: 321 - DNA, 19 bp, Artificial sequence
  Synthetic oligonucleotide
tatctttaccatcatttaa

SEQ ID NO: 322 - DNA, 18 bp, Artificial sequence
  Synthetic oligonucleotide
gttatctttaccatcatt

SEQ ID NO: 323 - DNA, 17 bp, Artificial sequence
  Synthetic oligonucleotide
agacttaccaaatttcc

SEQ ID NO: 324 - DNA, 16 bp, Artificial sequence
  Synthetic oligonucleotide
gaacatgttgactcac

SEQ ID NO: 325 - DNA, 18 bp, Artificial sequence
  Synthetic oligonucleotide
agttttaataccatttca

SEQ ID NO: 326 - DNA, 18 bp, Artificial sequence
  Synthetic oligonucleotide
cagttttaataccatttc

SEQ ID NO: 327 - DNA, 19 bp, Artificial sequence
  Synthetic oligonucleotide
ataatttatccttaattct

SEQ ID NO: 328 - DNA, 17 bp, Artificial sequence
  Synthetic oligonucleotide
tcaatgtttccaatctt

SEQ ID NO: 329 - DNA, 19 bp, Artificial sequence
  Synthetic oligonucleotide
catctggttacataccacc

SEQ ID NO: 330 - DNA, 19 bp, Artificial sequence
  Synthetic oligonucleotide
atcacaaaataatttccac

SEQ ID NO: 331 - DNA, 19 bp, Artificial sequence
  Synthetic oligonucleotide
catcacaaaataatttcca

SEQ ID NO: 332 - DNA, 19 bp, Artificial sequence
  Synthetic oligonucleotide
tcatcacaaaataatttcc

SEQ ID NO: 333 - DNA, 18 bp, Artificial sequence
  Synthetic oligonucleotide
tagatcacatcatcacaa

SEQ ID NO: 334 - DNA, 20 bp, Artificial sequence
  Synthetic oligonucleotide
cctaaatacctttcttttca

SEQ ID NO: 335 - DNA, 19 bp, Artificial sequence
  Synthetic oligonucleotide
atacctaaatacctttctt

SEQ ID NO: 336 - DNA, 20 bp, Artificial sequence
  Synthetic oligonucleotide
ccctaaataatacctaaaca

SEQ ID NO: 337 - DNA, 18 bp, Artificial sequence
  Synthetic oligonucleotide
tccaccctaaataatacc

SEQ ID NO: 338 - DNA, 19 bp, Artificial sequence
  Synthetic oligonucleotide
agttaacactaattctaca

SEQ ID NO: 339 - DNA, 18 bp, Artificial sequence
  Synthetic oligonucleotide
gtctctaatatttctata

SEQ ID NO: 340 - DNA, 18 bp, Artificial sequence
  Synthetic oligonucleotide
tagcattcatctatcatt

SEQ ID NO: 341 - DNA, 17 bp, Artificial sequence
  Synthetic oligonucleotide
cctagcattcatctatc

SEQ ID NO: 342 - DNA, 19 bp, Artificial sequence
  Synthetic oligonucleotide
gtttcacataatttattcc

SEQ ID NO: 343 - DNA, 16 bp, Artificial sequence
  Synthetic oligonucleotide
ttagaataaattcacg

SEQ ID NO: 344 - DNA, 20 bp, Artificial sequence
  Synthetic oligonucleotide
taatttctcaaaaaattaaa

SEQ ID NO: 345 - DNA, 19 bp, Artificial sequence
  Synthetic oligonucleotide
ccttcattatttctcaatt

SEQ ID NO: 346 - DNA, 18 bp, Artificial sequence
  Synthetic oligonucleotide
cacaaccatcactatttc

SEQ ID NO: 347 - DNA, 20 bp, Artificial sequence
  Synthetic oligonucleotide
ttattacaatctattttaca

SEQ ID NO: 348 - DNA, 19 bp, Artificial sequence
  Synthetic oligonucleotide
cactcaattccatacttat

SEQ ID NO: 349 - DNA, 17 bp, Artificial sequence
  Synthetic oligonucleotide
actcaattccatactta

SEQ ID NO: 350 - DNA, 19 bp, Artificial sequence
  Synthetic oligonucleotide
tctcttttaaattcaatct

SEQ ID NO: 351 - DNA, 20 bp, Artificial sequence
  Synthetic oligonucleotide
tatctcttttaaattcaatc

SEQ ID NO: 352 - DNA, 19 bp, Artificial sequence
  Synthetic oligonucleotide
gctatctcttttaaattca

SEQ ID NO: 353 - DNA, 18 bp, Artificial sequence
  Synthetic oligonucleotide
gtaatttatcaatttcca

SEQ ID NO: 354 - DNA, 20 bp, Artificial sequence
  Synthetic oligonucleotide
aatcttttcttaatctttta

SEQ ID NO: 355 - DNA, 19 bp, Artificial sequence
  Synthetic oligonucleotide
gtacaataccattacaaca

SEQ ID NO: 356 - DNA, 18 bp, Artificial sequence
  Synthetic oligonucleotide
cagttttacttttcaata

SEQ ID NO: 357 - DNA, 19 bp, Artificial sequence
  Synthetic oligonucleotide
atcaattctacttaataca

SEQ ID NO: 358 - DNA, 20 bp, Artificial sequence
  Synthetic oligonucleotide
tattcttattttcatatata

SEQ ID NO: 359 - DNA, 19 bp, Artificial sequence
  Synthetic oligonucleotide
atattcttattttcatata

SEQ ID NO: 360 - DNA, 17 bp, Artificial sequence
  Synthetic oligonucleotide
aatgatcaatcaccctt

SEQ ID NO: 361 - DNA, 17 bp, Artificial sequence
  Synthetic oligonucleotide
ttgatctacttaattta

SEQ ID NO: 362 - DNA, 16 bp, Artificial sequence
  Synthetic oligonucleotide
agtcccataactaaca

SEQ ID NO: 363 - DNA, 19 bp, Artificial sequence
  Synthetic oligonucleotide
tatcacttattcattcata

SEQ ID NO: 364 - DNA, 19 bp, Artificial sequence
  Synthetic oligonucleotide
ttatccatcttttaattta

SEQ ID NO: 365 - DNA, 20 bp, Artificial sequence
  Synthetic oligonucleotide
atatctttccatatttttca

SEQ ID NO: 366 - DNA, 18 bp, Artificial sequence
  Synthetic oligonucleotide
ggtaacaacttttaaata

SEQ ID NO: 367 - DNA, 18 bp, Artificial sequence
  Synthetic oligonucleotide
ctagtatacaacatcata

SEQ ID NO: 368 - DNA, 17 bp, Artificial sequence
  Synthetic oligonucleotide
acctagtatacaacatc

SEQ ID NO: 369 - DNA, 19 bp, Artificial sequence
  Synthetic oligonucleotide
accacattaaattctcaat

SEQ ID NO: 370 - DNA, 20 bp, Artificial sequence
  Synthetic oligonucleotide
ttacaactttatctttttta

SEQ ID NO: 371 - DNA, 16 bp, Artificial sequence
  Synthetic oligonucleotide
acaacctataccctat

SEQ ID NO: 372 - DNA, 16 bp, Artificial sequence
  Synthetic oligonucleotide
aggacaacctataccc

SEQ ID NO: 373 - DNA, 18 bp, Artificial sequence
  Synthetic oligonucleotide
tgatctttctatctacac

SEQ ID NO: 374 - DNA, 18 bp, Artificial sequence
  Synthetic oligonucleotide
ttgatctttctatctaca

SEQ ID NO: 375 - DNA, 17 bp, Artificial sequence
  Synthetic oligonucleotide
agccttatttaataatc

SEQ ID NO: 376 - DNA, 18 bp, Artificial sequence
  Synthetic oligonucleotide
tgtctttattttccaatc

SEQ ID NO: 377 - DNA, 18 bp, Artificial sequence
  Synthetic oligonucleotide
tgtttccataatatttct

SEQ ID NO: 378 - DNA, 17 bp, Artificial sequence
  Synthetic oligonucleotide
ccatataccttctccat

SEQ ID NO: 379 - DNA, 17 bp, Artificial sequence
  Synthetic oligonucleotide
tttccatataccttctc

SEQ ID NO: 380 - DNA, 18 bp, Artificial sequence
  Synthetic oligonucleotide
tcttttccatataccttc

SEQ ID NO: 381 - DNA, 20 bp, Artificial sequence
  Synthetic oligonucleotide
cactatacaaaactctacca

SEQ ID NO: 382 - DNA, 18 bp, Artificial sequence
  Synthetic oligonucleotide
accctcactatacaaaac

SEQ ID NO: 383 - DNA, 17 bp, Artificial sequence
  Synthetic oligonucleotide
caccctcactatacaaa

SEQ ID NO: 384 - DNA, 18 bp, Artificial sequence
  Synthetic oligonucleotide
agcacaatataaaaccac

SEQ ID NO: 385 - DNA, 18 bp, Artificial sequence
  Synthetic oligonucleotide
ttaacattatctttccaa

SEQ ID NO: 386 - DNA, 18 bp, Artificial sequence
  Synthetic oligonucleotide
ctagcactttaatttcca

SEQ ID NO: 387 - DNA, 18 bp, Artificial sequence
  Synthetic oligonucleotide
gaatctcttcttaactct

SEQ ID NO: 388 - DNA, 18 bp, Artificial sequence
  Synthetic oligonucleotide
aaataaatgactataact

SEQ ID NO: 389 - DNA, 18 bp, Artificial sequence
  Synthetic oligonucleotide
acacctttctaaacaata

SEQ ID NO: 390 - DNA, 18 bp, Artificial sequence
  Synthetic oligonucleotide
agtctttaaaccactttc

SEQ ID NO: 391 - DNA, 19 bp, Artificial sequence
  Synthetic oligonucleotide
accaaataatttcaacacc

SEQ ID NO: 392 - DNA, 19 bp, Artificial sequence
  Synthetic oligonucleotide
tccctcaaccaaataattt

SEQ ID NO: 393 - DNA, 16 bp, Artificial sequence
  Synthetic oligonucleotide
tccaccagatttttcc

SEQ ID NO: 394 - DNA, 16 bp, Artificial sequence
  Synthetic oligonucleotide
aagctttcaaaccaac

SEQ ID NO: 395 - DNA, 18 bp, Artificial sequence
  Synthetic oligonucleotide
ttatcctaaaactaccat

SEQ ID NO: 396 - DNA, 17 bp, Artificial sequence
  Synthetic oligonucleotide
aagcacctcatatcttc

SEQ ID NO: 397 - DNA, 19 bp, Artificial sequence
  Synthetic oligonucleotide
ttaccactcatttatttct

SEQ ID NO: 398 - DNA, 17 bp, Artificial sequence
  Synthetic oligonucleotide
agttaccactcatttat

SEQ ID NO: 399 - DNA, 19 bp, Artificial sequence
  Synthetic oligonucleotide
tactctaaaattatcctta

SEQ ID NO: 400 - DNA, 18 bp, Artificial sequence
  Synthetic oligonucleotide
cagattcttcttattcta

SEQ ID NO: 401 - DNA, 18 bp, Artificial sequence
  Synthetic oligonucleotide
gttctaatattcctcaca

SEQ ID NO: 402 - DNA, 19 bp, Artificial sequence
  Synthetic oligonucleotide
ctcttatcttccaatttta

SEQ ID NO: 403 - DNA, 20 bp, Artificial sequence
  Synthetic oligonucleotide
tctataatttcttcttattt

SEQ ID NO: 404 - DNA, 19 bp, Artificial sequence
  Synthetic oligonucleotide
cttctataatttcttctta

SEQ ID NO: 405 - DNA, 20 bp, Artificial sequence
  Synthetic oligonucleotide
tccttctataatttcttctt

SEQ ID NO: 406 - DNA, 19 bp, Artificial sequence
  Synthetic oligonucleotide
attccttctataatttctt

SEQ ID NO: 407 - DNA, 19 bp, Artificial sequence
  Synthetic oligonucleotide
cattccttctataatttct

SEQ ID NO: 408 - DNA, 19 bp, Artificial sequence
  Synthetic oligonucleotide
acattccttctataatttc

SEQ ID NO: 409 - DNA, 19 bp, Artificial sequence
  Synthetic oligonucleotide
gccatatctcttaatttaa

SEQ ID NO: 410 - DNA, 17 bp, Artificial sequence
  Synthetic oligonucleotide
agccatatctcttaatt

SEQ ID NO: 411 - DNA, 17 bp, Artificial sequence
  Synthetic oligonucleotide
acagccatatctcttaa

SEQ ID NO: 412 - DNA, 17 bp, Artificial sequence
  Synthetic oligonucleotide
taagtttcaaataaccc

SEQ ID NO: 413 - DNA, 18 bp, Artificial sequence
  Synthetic oligonucleotide
tccattattttccactta

SEQ ID NO: 414 - DNA, 18 bp, Artificial sequence
  Synthetic oligonucleotide
acatccattattttccac

SEQ ID NO: 415 - DNA, 19 bp, Artificial sequence
  Synthetic oligonucleotide
tcacatccattattttcca

SEQ ID NO: 416 - DNA, 18 bp, Artificial sequence
  Synthetic oligonucleotide
ttcacatccattattttc

SEQ ID NO: 417 - DNA, 19 bp, Artificial sequence
  Synthetic oligonucleotide
tcattcacatccattattt

SEQ ID NO: 418 - DNA, 20 bp, Artificial sequence
  Synthetic oligonucleotide
ttatatatttatctatttca

SEQ ID NO: 419 - DNA, 18 bp, Artificial sequence
  Synthetic oligonucleotide
agcaatacaatcaataca

SEQ ID NO: 420 - DNA, 17 bp, Artificial sequence
  Synthetic oligonucleotide
ccacaattaccataacc

SEQ ID NO: 421 - DNA, 17 bp, Artificial sequence
  Synthetic oligonucleotide
caccaaagatctaccaa

SEQ ID NO: 422 - DNA, 18 bp, Artificial sequence
  Synthetic oligonucleotide
tattttcttaccctcatt

SEQ ID NO: 423 - DNA, 18 bp, Artificial sequence
  Synthetic oligonucleotide
agtattttcttaccctca

SEQ ID NO: 424 - DNA, 17 bp, Artificial sequence
  Synthetic oligonucleotide
tagtattttcttaccct

SEQ ID NO: 425 - DNA, 17 bp, Artificial sequence
  Synthetic oligonucleotide
ttagtattttcttaccc

SEQ ID NO: 426 - DNA, 19 bp, Artificial sequence
  Synthetic oligonucleotide
ttataattccacttacttt

SEQ ID NO: 427 - DNA, 18 bp, Artificial sequence
  Synthetic oligonucleotide
gttataattccacttact

SEQ ID NO: 428 - DNA, 18 bp, Artificial sequence
  Synthetic oligonucleotide
tagttataattccactta

SEQ ID NO: 429 - DNA, 17 bp, Artificial sequence
  Synthetic oligonucleotide
tttagttataattccac

SEQ ID NO: 430 - DNA, 18 bp, Artificial sequence
  Synthetic oligonucleotide
gttttctcaaatataatt

SEQ ID NO: 431 - DNA, 18 bp, Artificial sequence
  Synthetic oligonucleotide
gaattctaataccacctt

SEQ ID NO: 432 - DNA, 19 bp, Artificial sequence
  Synthetic oligonucleotide
atatactaaactattctcc

SEQ ID NO: 433 - DNA, 20 bp, Artificial sequence
  Synthetic oligonucleotide
ttcatttatccttcaaaata

SEQ ID NO: 434 - DNA, 20 bp, Artificial sequence
  Synthetic oligonucleotide
ttcattatttcatttatcct

SEQ ID NO: 435 - DNA, 20 bp, Artificial sequence
  Synthetic oligonucleotide
tttaatcctttctttatttc

SEQ ID NO: 436 - DNA, 18 bp, Artificial sequence
  Synthetic oligonucleotide
cagtttttctttaatcct

SEQ ID NO: 437 - DNA, 18 bp, Artificial sequence
  Synthetic oligonucleotide
atgatcctattattacca

SEQ ID NO: 438 - DNA, 17 bp, Artificial sequence
  Synthetic oligonucleotide
ttgactaacattcataa

SEQ ID NO: 439 - DNA, 16 bp, Artificial sequence
  Synthetic oligonucleotide
ttccatcgcacatttt

SEQ ID NO: 440 - DNA, 20 bp, Artificial sequence
  Synthetic oligonucleotide
acataaccttttatttttta

SEQ ID NO: 441 - DNA, 17 bp, Artificial sequence
  Synthetic oligonucleotide
cattctaaatcttagtc

SEQ ID NO: 442 - DNA, 17 bp, Artificial sequence
  Synthetic oligonucleotide
ataatcgtccatccctt

SEQ ID NO: 443 - DNA, 18 bp, Artificial sequence
  Synthetic oligonucleotide
tcacataaactcatccaa

SEQ ID NO: 444 - DNA, 17 bp, Artificial sequence
  Synthetic oligonucleotide
ttcacataaactcatcc

SEQ ID NO: 445 - DNA, 19 bp, Artificial sequence
  Synthetic oligonucleotide
acttatttcacataaactc

SEQ ID NO: 446 - DNA, 18 bp, Artificial sequence
  Synthetic oligonucleotide
cttcaaataactacaaag

SEQ ID NO: 447 - DNA, 17 bp, Artificial sequence
  Synthetic oligonucleotide
tgtattcattacatact

SEQ ID NO: 448 - DNA, 19 bp, Artificial sequence
  Synthetic oligonucleotide
actcttaacaatttattca

SEQ ID NO: 449 - DNA, 20 bp, Artificial sequence
  Synthetic oligonucleotide
tcactcttaacaatttattc

SEQ ID NO: 450 - DNA, 20 bp, Artificial sequence
  Synthetic oligonucleotide
taacataatcactcttaaca

SEQ ID NO: 451 - DNA, 17 bp, Artificial sequence
  Synthetic oligonucleotide
ccagaacctattattta

SEQ ID NO: 452 - DNA, 18 bp, Artificial sequence
  Synthetic oligonucleotide
attattcaatcctctata

SEQ ID NO: 453 - DNA, 18 bp, Artificial sequence
  Synthetic oligonucleotide
taaccttcatcacatact

SEQ ID NO: 454 - DNA, 20 bp, Artificial sequence
  Synthetic oligonucleotide
atctaaccttcatcacatac

SEQ ID NO: 455 - DNA, 18 bp, Artificial sequence
  Synthetic oligonucleotide
tctaaccttcatcacata

SEQ ID NO: 456 - DNA, 18 bp, Artificial sequence
  Synthetic oligonucleotide
ctctatctaaccttcatc

SEQ ID NO: 457 - DNA, 18 bp, Artificial sequence
  Synthetic oligonucleotide
tgactctatctaaccttc

SEQ ID NO: 458 - DNA, 20 bp, Artificial sequence
  Synthetic oligonucleotide
cctcttttatcaacacaatt

SEQ ID NO: 459 - DNA, 19 bp, Artificial sequence
  Synthetic oligonucleotide
tctccaaatcttaaatttc

SEQ ID NO: 460 - DNA, 19 bp, Artificial sequence
  Synthetic oligonucleotide
tttactatttctccaaatc

SEQ ID NO: 461 - DNA, 20 bp, Artificial sequence
  Synthetic oligonucleotide
tcttttactatttctccaaa

SEQ ID NO: 462 - DNA, 20 bp, Artificial sequence
  Synthetic oligonucleotide
catcttttactatttctcca

SEQ ID NO: 463 - DNA, 19 bp, Artificial sequence
  Synthetic oligonucleotide
tcatcttttactatttctc

SEQ ID NO: 464 - DNA, 18 bp, Artificial sequence
  Synthetic oligonucleotide
cctcatcttttactattt

SEQ ID NO: 465 - DNA, 17 bp, Artificial sequence
  Synthetic oligonucleotide
aacctcatcttttacta

SEQ ID NO: 466 - DNA, 18 bp, Artificial sequence
  Synthetic oligonucleotide
tttttatatctactctca

SEQ ID NO: 467 - DNA, 19 bp, Artificial sequence
  Synthetic oligonucleotide
ttaataaacatcaatctcc

SEQ ID NO: 468 - DNA, 19 bp, Artificial sequence
  Synthetic oligonucleotide
atatttcctattctccatt

SEQ ID NO: 469 - DNA, 16 bp, Artificial sequence
  Synthetic oligonucleotide
catactgctctttcta

SEQ ID NO: 470 - DNA, 18 bp, Artificial sequence
  Synthetic oligonucleotide
atgcaaataacttcatca

SEQ ID NO: 471 - DNA, 19 bp, Artificial sequence
  Synthetic oligonucleotide
tttaactttcttaccacaa

SEQ ID NO: 472 - DNA, 17 bp, Artificial sequence
  Synthetic oligonucleotide
ttaactttcttaccaca

SEQ ID NO: 473 - DNA, 18 bp, Artificial sequence
  Synthetic oligonucleotide
catattcatctcacctac

SEQ ID NO: 474 - DNA, 18 bp, Artificial sequence
  Synthetic oligonucleotide
tcatattcatctcaccta

SEQ ID NO: 475 - DNA, 18 bp, Artificial sequence
  Synthetic oligonucleotide
ttcatattcatctcacct

SEQ ID NO: 476 - DNA, 20 bp, Artificial sequence
  Synthetic oligonucleotide
aattttcatattcatctcac

SEQ ID NO: 477 - DNA, 20 bp, Artificial sequence
  Synthetic oligonucleotide
ctacctttttaattctaaat

SEQ ID NO: 478 - DNA, 18 bp, Artificial sequence
  Synthetic oligonucleotide
actacctttttaattcta

SEQ ID NO: 479 - DNA, 18 bp, Artificial sequence
  Synthetic oligonucleotide
tgactacctttttaattc

SEQ ID NO: 480 - DNA, 17 bp, Artificial sequence
  Synthetic oligonucleotide
tatatttttttacccct

SEQ ID NO: 481 - DNA, 17 bp, Artificial sequence
  Synthetic oligonucleotide
tcaaatatacatccttg

SEQ ID NO: 482 - DNA, 16 bp, Artificial sequence
  Synthetic oligonucleotide
gtcaaatatacatcct

SEQ ID NO: 483 - DNA, 16 bp, Artificial sequence
  Synthetic oligonucleotide
ggtcaaatatacatcc

SEQ ID NO: 484 - DNA, 16 bp, Artificial sequence
  Synthetic oligonucleotide
aggtcaaatatacatc

SEQ ID NO: 485 - DNA, 19 bp, Artificial sequence
  Synthetic oligonucleotide
accacatttatccaatata

SEQ ID NO: 486 - DNA, 20 bp, Artificial sequence
  Synthetic oligonucleotide
ataaaaaccacatttatcca

SEQ ID NO: 487 - DNA, 18 bp, Artificial sequence
  Synthetic oligonucleotide
atcacaaccacaaaatca

SEQ ID NO: 488 - DNA, 19 bp, Artificial sequence
  Synthetic oligonucleotide
ataaatattcttacctaca

SEQ ID NO: 489 - DNA, 18 bp, Artificial sequence
  Synthetic oligonucleotide
aagtataatttccttcta

SEQ ID NO: 490 - DNA, 19 bp, Artificial sequence
  Synthetic oligonucleotide
aatttatagattaataaat

SEQ ID NO: 491 - DNA, 18 bp, Artificial sequence
  Synthetic oligonucleotide
tttccacatatttcctac

SEQ ID NO: 492 - DNA, 18 bp, Artificial sequence
  Synthetic oligonucleotide
tgtctatttccacatatt

SEQ ID NO: 493 - DNA, 19 bp, Artificial sequence
  Synthetic oligonucleotide
tctttcaaccttttattta

SEQ ID NO: 494 - DNA, 18 bp, Artificial sequence
  Synthetic oligonucleotide
atataaatcacctgaaat

SEQ ID NO: 495 - DNA, 18 bp, Artificial sequence
  Synthetic oligonucleotide
attaattccatcttcctt

SEQ ID NO: 496 - DNA, 18 bp, Artificial sequence
  Synthetic oligonucleotide
tcattaattccatcttcc

SEQ ID NO: 497 - DNA, 18 bp, Artificial sequence
  Synthetic oligonucleotide
tgtcattaattccatctt

SEQ ID NO: 498 - DNA, 17 bp, Artificial sequence
  Synthetic oligonucleotide
aacatgtcattaattcc

SEQ ID NO: 499 - DNA, 16 bp, Artificial sequence
  Synthetic oligonucleotide
ccttcaactgaacttc

SEQ ID NO: 500 - DNA, 18 bp, Artificial sequence
  Synthetic oligonucleotide
agccatatcttttttatt

SEQ ID NO: 501 - DNA, 18 bp, Artificial sequence
  Synthetic oligonucleotide
taagcacctcaaaatata

SEQ ID NO: 502 - DNA, 20 bp, Artificial sequence
  Synthetic oligonucleotide
ttattcatactaaacacata

SEQ ID NO: 503 - DNA, 17 bp, Artificial sequence
  Synthetic oligonucleotide
aaagatctcatattcct

SEQ ID NO: 504 - DNA, 19 bp, Artificial sequence
  Synthetic oligonucleotide
tctcattctttaaccataa

SEQ ID NO: 505 - DNA, 19 bp, Artificial sequence
  Synthetic oligonucleotide
tccctacttaaattatcaa

SEQ ID NO: 506 - DNA, 18 bp, Artificial sequence
  Synthetic oligonucleotide
gcaatgtaaaaacattaa

SEQ ID NO: 507 - DNA, 20 bp, Artificial sequence
  Synthetic oligonucleotide
cccatattttttattttaca

SEQ ID NO: 508 - DNA, 20 bp, Artificial sequence
  Synthetic oligonucleotide
cccttatctacaaaaattta

SEQ ID NO: 509 - DNA, 17 bp, Artificial sequence
  Synthetic oligonucleotide
ctgctttatttacatat

SEQ ID NO: 510 - DNA, 17 bp, Artificial sequence
  Synthetic oligonucleotide
actgctttatttacata

SEQ ID NO: 511 - DNA, 17 bp, Artificial sequence
  Synthetic oligonucleotide
tctcaagtataactaca

SEQ ID NO: 512 - DNA, 17 bp, Artificial sequence
  Synthetic oligonucleotide
actgctgagcaggatca

SEQ ID NO: 513 - DNA, 17 bp, Artificial sequence
  Synthetic oligonucleotide
gctgagcaggatcatga

SEQ ID NO: 514 - DNA, 18 bp, Artificial sequence
  Synthetic oligonucleotide
aaaatccagccagttcca

SEQ ID NO: 515 - DNA, 17 bp, Artificial sequence
  Synthetic oligonucleotide
actgcaatgtacatgtt

SEQ ID NO: 516 - DNA, 16 bp, Artificial sequence
  Synthetic oligonucleotide
tctatttgcttagctg

SEQ ID NO: 517 - DNA, 17 bp, Artificial sequence
  Synthetic oligonucleotide
ctatttgcttagctgtt

SEQ ID NO: 518 - DNA, 16 bp, Artificial sequence
  Synthetic oligonucleotide
ctgagcaggatcatga

SEQ ID NO: 519 - DNA, 17 bp, Artificial sequence
  Synthetic oligonucleotide
aaaatccagccagttcc

SEQ ID NO: 520 - DNA, 17 bp, Artificial sequence
  Synthetic oligonucleotide
tctatttgcttagctgt

SEQ ID NO: 521 - DNA, 18 bp, Artificial sequence
  Synthetic oligonucleotide
tctatttgcttagctgtt

SEQ ID NO: 522 - DNA, 16 bp, Artificial sequence
  Synthetic oligonucleotide
tgctgagcaggatcat

SEQ ID NO: 523 - DNA, 16 bp, Artificial sequence
  Synthetic oligonucleotide
actgcaatgtacatgt

SEQ ID NO: 524 - DNA, 15 bp, Artificial sequence
  Synthetic oligonucleotide
attaggttctctaat

SEQ ID NO: 525 - DNA, 15 bp, Artificial sequence
  Synthetic oligonucleotide
actgcaatgtacatg

SEQ ID NO: 526 - DNA, 17 bp, Artificial sequence
  Synthetic oligonucleotide
gcaatgtacatgttcac

SEQ ID NO: 527 - DNA, 16 bp, Artificial sequence
  Synthetic oligonucleotide
caatgtacatgttcac

SEQ ID NO: 528 - DNA, 18 bp, Artificial sequence
  Synthetic oligonucleotide
gtagatgaacatgaccag

SEQ ID NO: 529 - DNA, 20 bp, Artificial sequence
  Synthetic oligonucleotide
gtagatgaacatgaccagga

SEQ ID NO: 530 - DNA, 17 bp, Artificial sequence
  Synthetic oligonucleotide
gtagatgaacatgacca

SEQ ID NO: 531 - DNA, 19 bp, Artificial sequence
  Synthetic oligonucleotide
gtagatgaacatgaccagg

SEQ ID NO: 532 - DNA, 15 bp, Artificial sequence
  Synthetic oligonucleotide
tagatgaacatgacc

SEQ ID NO: 533 - DNA, 16 bp, Artificial sequence
  Synthetic oligonucleotide
tagatgaacatgacca

SEQ ID NO: 534 - DNA, 18 bp, Artificial sequence
  Synthetic oligonucleotide
tagatgaacatgaccagg

SEQ ID NO: 535 - DNA, 19 bp, Artificial sequence
  Synthetic oligonucleotide
tagatgaacatgaccagga

SEQ ID NO: 536 - DNA, 20 bp, Artificial sequence
  Synthetic oligonucleotide
tagatgaacatgaccaggaa

SEQ ID NO: 537 - DNA, 18 bp, Artificial sequence
  Synthetic oligonucleotide
agatgaacatgaccagga

SEQ ID NO: 538 - DNA, 17 bp, Artificial sequence
  Synthetic oligonucleotide
agatgaacatgaccagg

SEQ ID NO: 539 - DNA, 19 bp, Artificial sequence
  Synthetic oligonucleotide
agatgaacatgaccaggaa

SEQ ID NO: 540 - DNA, 16 bp, Artificial sequence
  Synthetic oligonucleotide
gatgaacatgaccagg

SEQ ID NO: 541 - DNA, 18 bp, Artificial sequence
  Synthetic oligonucleotide
gatgaacatgaccaggaa

SEQ ID NO: 542 - DNA, 17 bp, Artificial sequence
  Synthetic oligonucleotide
gatgaacatgaccagga

SEQ ID NO: 543 - DNA, 16 bp, Artificial sequence
  Synthetic oligonucleotide
atgaacatgaccagga

SEQ ID NO: 544 - DNA, 16 bp, Artificial sequence
  Synthetic oligonucleotide
tgaacatgaccaggaa

SEQ ID NO: 545 - DNA, 14 bp, Artificial sequence
  Synthetic oligonucleotide
gtgaagtagtagtg

SEQ ID NO: 546 - DNA, 20 bp, Artificial sequence
  Synthetic oligonucleotide
acttatcttctttttctgtt

SEQ ID NO: 547 - DNA, 19 bp, Artificial sequence
  Synthetic oligonucleotide
acttatcttctttttctgt

SEQ ID NO: 548 - DNA, 18 bp, Artificial sequence
  Synthetic oligonucleotide
cttatcttctttttctgt

SEQ ID NO: 549 - DNA, 20 bp, Artificial sequence
  Synthetic oligonucleotide
cttatcttctttttctgttg

SEQ ID NO: 550 - DNA, 19 bp, Artificial sequence
  Synthetic oligonucleotide
cttatcttctttttctgtt

SEQ ID NO: 551 - DNA, 18 bp, Artificial sequence
  Synthetic oligonucleotide
ttatcttctttttctgtt

SEQ ID NO: 552 - DNA, 17 bp, Artificial sequence
  Synthetic oligonucleotide
ttatcttctttttctgt

SEQ ID NO: 553 - DNA, 19 bp, Artificial sequence
  Synthetic oligonucleotide
ttatcttctttttctgttg

SEQ ID NO: 554 - DNA, 18 bp, Artificial sequence
  Synthetic oligonucleotide
tatcttctttttctgttg

SEQ ID NO: 555 - DNA, 17 bp, Artificial sequence
  Synthetic oligonucleotide
atcttctttttctgttg

SEQ ID NO: 556 - DNA, 15 bp, Artificial sequence
  Synthetic oligonucleotide
tcccatgatgctgaa

SEQ ID NO: 557 - DNA, 18 bp, Artificial sequence
  Synthetic oligonucleotide
actgctgagcaggatcat

SEQ ID NO: 558 - DNA, 17 bp, Artificial sequence
  Synthetic oligonucleotide
ctgctgagcaggatcat

SEQ ID NO: 559 - DNA, 17 bp, Artificial sequence
  Synthetic oligonucleotide
tgctgagcaggatcatg

SEQ ID NO: 560 - DNA, 15 bp, Artificial sequence
  Synthetic oligonucleotide
tgagcaggatcatga

SEQ ID NO: 561 - DNA, 17 bp, Artificial sequence
  Synthetic oligonucleotide
tctctatccactctcca

SEQ ID NO: 562 - DNA, 16 bp, Artificial sequence
  Synthetic oligonucleotide
ctctatccactctcca

SEQ ID NO: 563 - DNA, 17 bp, Artificial sequence
  Synthetic oligonucleotide
ctctatccactctccac

SEQ ID NO: 564 - DNA, 18 bp, Artificial sequence
  Synthetic oligonucleotide
ctctatccactctccaca

SEQ ID NO: 565 - DNA, 20 bp, Artificial sequence
  Synthetic oligonucleotide
ggaaggagtggaagaagtcg

SEQ ID NO: 566 - DNA, 20 bp, Artificial sequence
  Synthetic oligonucleotide
gaaggagtggaagaagtcgt

SEQ ID NO: 567 - DNA, 19 bp, Artificial sequence
  Synthetic oligonucleotide
gaaggagtggaagaagtcg

SEQ ID NO: 568 - DNA, 18 bp, Artificial sequence
  Synthetic oligonucleotide
aaggagtggaagaagtcg

SEQ ID NO: 569 - DNA, 19 bp, Artificial sequence
  Synthetic oligonucleotide
aaggagtggaagaagtcgt

SEQ ID NO: 570 - DNA, 17 bp, Artificial sequence
  Synthetic oligonucleotide
aggagtggaagaagtcg

SEQ ID NO: 571 - DNA, 18 bp, Artificial sequence
  Synthetic oligonucleotide
aggagtggaagaagtcgt

SEQ ID NO: 572 - DNA, 16 bp, Artificial sequence
  Synthetic oligonucleotide
ggagtggaagaagtcg

SEQ ID NO: 573 - DNA, 17 bp, Artificial sequence
  Synthetic oligonucleotide
ggagtggaagaagtcgt

SEQ ID NO: 574 - DNA, 18 bp, Artificial sequence
  Synthetic oligonucleotide
gagtggaagaagtcgttc

SEQ ID NO: 575 - DNA, 17 bp, Artificial sequence
  Synthetic oligonucleotide
gagtggaagaagtcgtt

SEQ ID NO: 576 - DNA, 20 bp, Artificial sequence
  Synthetic oligonucleotide
gagtggaagaagtcgttcat

SEQ ID NO: 577 - DNA, 15 bp, Artificial sequence
  Synthetic oligonucleotide
gagtggaagaagtcg

SEQ ID NO: 578 - DNA, 19 bp, Artificial sequence
  Synthetic oligonucleotide
gagtggaagaagtcgttca

SEQ ID NO: 579 - DNA, 16 bp, Artificial sequence
  Synthetic oligonucleotide
gagtggaagaagtcgt

SEQ ID NO: 580 - DNA, 18 bp, Artificial sequence
  Synthetic oligonucleotide
agtggaagaagtcgttca

SEQ ID NO: 581 - DNA, 19 bp, Artificial sequence
  Synthetic oligonucleotide
agtggaagaagtcgttcat

SEQ ID NO: 582 - DNA, 20 bp, Artificial sequence
  Synthetic oligonucleotide
agtggaagaagtcgttcatg

SEQ ID NO: 583 - DNA, 15 bp, Artificial sequence
  Synthetic oligonucleotide
agtggaagaagtcgt

SEQ ID NO: 584 - DNA, 16 bp, Artificial sequence
  Synthetic oligonucleotide
agtggaagaagtcgtt

SEQ ID NO: 585 - DNA, 17 bp, Artificial sequence
  Synthetic oligonucleotide
agtggaagaagtcgttc

SEQ ID NO: 586 - DNA, 16 bp, Artificial sequence
  Synthetic oligonucleotide
gtggaagaagtcgttc

SEQ ID NO: 587 - DNA, 14 bp, Artificial sequence
  Synthetic oligonucleotide
gtggaagaagtcgt

SEQ ID NO: 588 - DNA, 18 bp, Artificial sequence
  Synthetic oligonucleotide
gtggaagaagtcgttcat

SEQ ID NO: 589 - DNA, 19 bp, Artificial sequence
  Synthetic oligonucleotide
gtggaagaagtcgttcatg

SEQ ID NO: 590 - DNA, 17 bp, Artificial sequence
  Synthetic oligonucleotide
gtggaagaagtcgttca

SEQ ID NO: 591 - DNA, 20 bp, Artificial sequence
  Synthetic oligonucleotide
gtggaagaagtcgttcatgt

SEQ ID NO: 592 - DNA, 15 bp, Artificial sequence
  Synthetic oligonucleotide
gtggaagaagtcgtt

SEQ ID NO: 593 - DNA, 20 bp, Artificial sequence
  Synthetic oligonucleotide
tggaagaagtcgttcatgtg

SEQ ID NO: 594 - DNA, 16 bp, Artificial sequence
  Synthetic oligonucleotide
tggaagaagtcgttca

SEQ ID NO: 595 - DNA, 18 bp, Artificial sequence
  Synthetic oligonucleotide
tggaagaagtcgttcatg

SEQ ID NO: 596 - DNA, 15 bp, Artificial sequence
  Synthetic oligonucleotide
tggaagaagtcgttc

SEQ ID NO: 597 - DNA, 17 bp, Artificial sequence
  Synthetic oligonucleotide
tggaagaagtcgttcat

SEQ ID NO: 598 - DNA, 19 bp, Artificial sequence
  Synthetic oligonucleotide
tggaagaagtcgttcatgt

SEQ ID NO: 599 - DNA, 15 bp, Artificial sequence
  Synthetic oligonucleotide
ggaagaagtcgttca

SEQ ID NO: 600 - DNA, 16 bp, Artificial sequence
  Synthetic oligonucleotide
ggaagaagtcgttcat

SEQ ID NO: 601 - DNA, 18 bp, Artificial sequence
  Synthetic oligonucleotide
ggaagaagtcgttcatgt

SEQ ID NO: 602 - DNA, 20 bp, Artificial sequence
  Synthetic oligonucleotide
ggaagaagtcgttcatgtgc

SEQ ID NO: 603 - DNA, 17 bp, Artificial sequence
  Synthetic oligonucleotide
ggaagaagtcgttcatg

SEQ ID NO: 604 - DNA, 19 bp, Artificial sequence
  Synthetic oligonucleotide
ggaagaagtcgttcatgtg

SEQ ID NO: 605 - DNA, 18 bp, Artificial sequence
  Synthetic oligonucleotide
gaagaagtcgttcatgtg

SEQ ID NO: 606 - DNA, 19 bp, Artificial sequence
  Synthetic oligonucleotide
gaagaagtcgttcatgtgc

SEQ ID NO: 607 - DNA, 20 bp, Artificial sequence
  Synthetic oligonucleotide
gaagaagtcgttcatgtgcc

SEQ ID NO: 608 - DNA, 15 bp, Artificial sequence
  Synthetic oligonucleotide
gaagaagtcgttcat

SEQ ID NO: 609 - DNA, 16 bp, Artificial sequence
  Synthetic oligonucleotide
gaagaagtcgttcatg

SEQ ID NO: 610 - DNA, 17 bp, Artificial sequence
  Synthetic oligonucleotide
gaagaagtcgttcatgt

SEQ ID NO: 611 - DNA, 16 bp, Artificial sequence
  Synthetic oligonucleotide
aagaagtcgttcatgt

SEQ ID NO: 612 - DNA, 18 bp, Artificial sequence
  Synthetic oligonucleotide
aagaagtcgttcatgtgc

SEQ ID NO: 613 - DNA, 20 bp, Artificial sequence
  Synthetic oligonucleotide
aagaagtcgttcatgtgcca

SEQ ID NO: 614 - DNA, 15 bp, Artificial sequence
  Synthetic oligonucleotide
aagaagtcgttcatg

SEQ ID NO: 615 - DNA, 14 bp, Artificial sequence
  Synthetic oligonucleotide
aagaagtcgttcat

SEQ ID NO: 616 - DNA, 19 bp, Artificial sequence
  Synthetic oligonucleotide
aagaagtcgttcatgtgcc

SEQ ID NO: 617 - DNA, 17 bp, Artificial sequence
  Synthetic oligonucleotide
aagaagtcgttcatgtg

SEQ ID NO: 618 - DNA, 18 bp, Artificial sequence
  Synthetic oligonucleotide
agaagtcgttcatgtgcc

SEQ ID NO: 619 - DNA, 16 bp, Artificial sequence
  Synthetic oligonucleotide
agaagtcgttcatgtg

SEQ ID NO: 620 - DNA, 15 bp, Artificial sequence
  Synthetic oligonucleotide
agaagtcgttcatgt

SEQ ID NO: 621 - DNA, 17 bp, Artificial sequence
  Synthetic oligonucleotide
agaagtcgttcatgtgc

SEQ ID NO: 622 - DNA, 14 bp, Artificial sequence
  Synthetic oligonucleotide
agaagtcgttcatg

SEQ ID NO: 623 - DNA, 19 bp, Artificial sequence
  Synthetic oligonucleotide
agaagtcgttcatgtgcca

SEQ ID NO: 624 - DNA, 17 bp, Artificial sequence
  Synthetic oligonucleotide
gaagtcgttcatgtgcc

SEQ ID NO: 625 - DNA, 18 bp, Artificial sequence
  Synthetic oligonucleotide
gaagtcgttcatgtgcca

SEQ ID NO: 626 - DNA, 16 bp, Artificial sequence
  Synthetic oligonucleotide
gaagtcgttcatgtgc

SEQ ID NO: 627 - DNA, 16 bp, Artificial sequence
  Synthetic oligonucleotide
aagtcgttcatgtgcc

SEQ ID NO: 628 - DNA, 17 bp, Artificial sequence
  Synthetic oligonucleotide
aagtcgttcatgtgcca

SEQ ID NO: 629 - DNA, 15 bp, Artificial sequence
  Synthetic oligonucleotide
agtcgttcatgtgcc

SEQ ID NO: 630 - DNA, 16 bp, Artificial sequence
  Synthetic oligonucleotide
agtcgttcatgtgcca

SEQ ID NO: 631 - DNA, 14 bp, Artificial sequence
  Synthetic oligonucleotide
gtcgttcatgtgcc

SEQ ID NO: 632 - DNA, 14 bp, Artificial sequence
  Synthetic oligonucleotide
tcgttcatgtgcca

SEQ ID NO: 633 - DNA, 16 bp, Artificial sequence
  Synthetic oligonucleotide
ggccaggattttgcca

SEQ ID NO: 634 - DNA, 15 bp, Artificial sequence
  Synthetic oligonucleotide
ggccaggattttgcc

SEQ ID NO: 635 - DNA, 15 bp, Artificial sequence
  Synthetic oligonucleotide
tcaaagctcgtgtag

SEQ ID NO: 636 - DNA, 14 bp, Artificial sequence
  Synthetic oligonucleotide
caaagctcgtgtag

SEQ ID NO: 637 - DNA, 16 bp, Artificial sequence
  Synthetic oligonucleotide
aaagttcgaagagctg

SEQ ID NO: 638 - DNA, 16 bp, Artificial sequence
  Synthetic oligonucleotide
tatttgcttagctgtt

SEQ ID NO: 639 - DNA, 16 bp, Artificial sequence
  Synthetic oligonucleotide
gtagatgaacatgacc

SEQ ID NO: 640 - DNA, 17 bp, Artificial sequence
  Synthetic oligonucleotide
tagatgaacatgaccag

SEQ ID NO: 641 - DNA, 17 bp, Artificial sequence
  Synthetic oligonucleotide
atgaacatgaccaggaa

SEQ ID NO: 642 - DNA, 20 bp, Artificial sequence
  Synthetic oligonucleotide
ttcactaaatttcactaatc

SEQ ID NO: 643 - DNA, 16 bp, Artificial sequence
  Synthetic oligonucleotide
aatgtacttataccca

SEQ ID NO: 644 - DNA, 16 bp, Artificial sequence
  Synthetic oligonucleotide
cttacgcaaaaacaat

SEQ ID NO: 645 - DNA, 17 bp, Artificial sequence
  Synthetic oligonucleotide
acttacgcaaaaacaat

SEQ ID NO: 646 - DNA, 18 bp, Artificial sequence
  Synthetic oligonucleotide
tcacaccaattacttctt

SEQ ID NO: 647 - DNA, 20 bp, Artificial sequence
  Synthetic oligonucleotide
cttcacaccaattacttctt

SEQ ID NO: 648 - DNA, 19 bp, Artificial sequence
  Synthetic oligonucleotide
ttactttattcatctcata

SEQ ID NO: 649 - DNA, 18 bp, Artificial sequence
  Synthetic oligonucleotide
tactttattcatctcata

SEQ ID NO: 650 - DNA, 18 bp, Artificial sequence
  Synthetic oligonucleotide
ttgaaccttcattatttc

SEQ ID NO: 651 - DNA, 119411 bp, Homo sapiens
ttcttgcttcacacactagcctcttggctagagaacagacatcagatggagtttcttctggctatgcctgaatgttaagctgaacgtatgttccaggagctcgtggtctccagtagaggcaatctgggatagaagagaagatatttcttacgtagaagacaagcaagattgagcagcaaaggtttggctgtgcgactttgttagtctgtggctaacagtgtaaagatatgtgcttgggtattttgagggggattacagattttattcataaaccaaaaacaaagcatgttttgtgggatgttttaatatatgaccttcctcaaacacccatagttcttggaaaaatactattaatctatatgcatagaagactcccactgcatctcttcctctgaaggataagggtgaaaatatagctaaatccaaaagctatcaatttctacatgctacatcaacgtcaagtttatactcttcaaagagttgtgttgatataaaaagatgttttattagcagatgtgatttcagacatttaacaaaaactgtgataacagaggtcaaatgtcctggtagtattgacgaagttgttaaaactaaacaaaaaggggcacagaaagcaaagaatgcatggtctccgggtcagtggtgatacacagcttcagcaagacgttttgtcctaaactcaaggcaacaagttatcttgttagagaagtaaggatcaggatcagagcagtggatttcattcttagtcacacatcagaataaagtggagaactttttagaaacacagactcttggaccccactccaggcctattgactctgaatgtcaagggggtgagagtcagaaatctgtatttttcaaatgctctccagaaaattcagatggacaacaaggttgagaaacttttgttttcagatattgtgatgaaaaaagacaagcccaggtatccaagggtattattcagccttcagtgtagcatttatacacgttcagagaggtgacaacaggcaagaccaaagccacctaatctttgtttttaaccccaaatctgtaatccagaatgcctcattcagaaatttctgtggttctggctttgtttggctttttttcccccatagctctagcacacttagtgtaaatttgattcttgatcatgattttgatctttgagattacctgattagatttgtgccagaaaagagaaaacacttgctatgattttaaaacgtagtttgaatcagctttactggacttgcaaaatgaagcagggagaagcaaccacgtgtatatattttaagtaacagaagccaaaggttgggctttctagccacatgttgtggaaggaagtttgacacagataaatgaattgcttttaaactggtggaaatttttggtttgaaatggcataaagttggtttgaaatgttaggaaggttttagagtggccttaaaaagtaatttcctagttccctgtccacttagtcaaataatggtagtgataatagtaataataaatgagcatataaattgaaacattagcatgtttttgccccaagcatatgaaagagcacatacctacaaggataatttttgagataacaatcatcagaaggaaatgaaaaagaaacctgagaatggtctgtaatggtaaatggtagtaaagggtctttcacaaataaatattgccaagaaaatgttaaaccaggaggagaaacccactaattactgactctgggcatgtgcagtcatgtattcccttctgtcagcacccaatcaagtcaagaaggctcttaagaccttcagctttttttgtgagtgtcagccccaagattccccttagctccccctctctcagaatacagaccagccctatggtccccagatacaaagtgatactgtgagcttagtgtccccaactcctgagcccatgagtgaaacactgtccctgccccctcttaaattgctgtattctttctcattcagtttgcatccaccaggctctccctttctgcacaatcactttctgcccaaatcttacctgcctttccaactcctggatagatctcattctctcacaaggcatagtgccttccctctcttcctctgctcccacctcacttcttaatttgtgtttatttacatggtgcatgtctcattttagagtgccgcctgtatgtatctctctccccaccagagtgtgagtttatgagggtctccctctccttgacttctataccccatcaaaactttgcacatattagcagcccagtaagtgcttactgaataaaaatcatggcttggtgtcatggatcatatgggaataagattcgaatgtgacagcactttctctcacccttctcactaagcaaatacgttctgtcccttgcctgccagcattaattctgagaggcttagaactattaatatttgtccttagaatgtcactttggtccatcttgctcattagatcccatggtcactcttcttaccttggtatttatatattgtgcttttctctgttctccaaagatatctagagccatgttttatgaactagttcatgagggtaggaaggagtcagagtggccatggccagttatagagtacagtggctaagagcataggccttgtgaactcagctggaccttggttagggtccgtttcatcaattgtgacatggccataataatacctatgtcacaagacgactgtaaatattaaacaggggatgcacaaaaaggttagcctagtctattatctcctattcctattatcatttagtctgatacactcattttatatataaagaaactgagacgcggagtttcagttttagtgatttattcaaggccatgtagctggttactggcacaaggaacaggaagcccactcccctgcccacaatgtgaggtgacaagagggagtcctattggagacactttgttcatactctgtagggaggagccgaggtactcaaagcctagaatgaattcatcagcaggtgtgagcttgacttgcattaggcacaatcctttgggagataaggtggaatagtaattattattatgattattttaaggtgctcacagagctgaccagcagcaaaaatcagagaatgcttcagaaaaaggggaattgagggaggttgtgaataacaggtagacttatttatttatttatttatttgagacagggtctcactccaacacccaggctggagtgcagtggcacaatctcagctcactgcagccttgacctccagggctcaggtgatcctcctacctcagctcctgagtagctgggattacaggtggcctccaccacacttggaaaaattttgtggttttggtagagacagggtctcgccatgttgcccaggctggtctcgaactccttggctcaagtggtcctcctactgcagcctcccaaaatgatgggattacaggtgtgagctaccatgcccagcggtgggtagactttagatagatagaagagaggagaggtttctgtgcccagagtgcagtgacaggaagagaatcagaaacatctagcaagtgctgactctgacaacagaaaacgaacagtagttccctccaggcaggagaggggtagccactgggaaggggcatgggagagtcttctcgttttctacatctttgtcttgggggtagttacacaggtgtttgcatatgttttttaaaaagcatcaaactgtaaacttcagatgaatgaacttggtgtactttgcgtatgtattcctcaattaaaaaaaaaatcaccagtactaccactccccaagaatgatgtgttaatatttttattcattacctactgagcagaagagataagaacattgccttaggtctccaataggctatgaccttcactaagttagcctcaaggctttagtggcttctctgcagaaatgggttaattataggatatgctcctatgattgtgtgaggataaaatgacagtgttcataaaatacttagcactatgcccaaaatatagaaagcaagcaagaagatacttttattagtaagacaatcatcttttttgttcaatttttaaacacataaagctgtgatcacattttttaaaagcgctggctgccttggtggatggtcataggctaagcatgggacagcagcactcaggctgccagctgccctggagcttattggcagtcaccatggatcaaggtgctcaggaagtattgattggttgcctggctcattgccccaccgtaaaccaagtgagcggcagggggctcgggacatcctggttggcccgctggttcagtggctggccagggactggtcagacacctcactgtttcccctgctccagtatattccagttgtagctttgtgggaaatcagtatgagaggaggaaaaagggaatcctggggaaattgatagccttggccctggacagtagaaagtcctggaaaatctgggttgttgtccagctctgcctcttattagctggagtcccaggcaagatccattacctagtctcaaattctgcaactgttggttggaagagttgcacattaggaagactgtatgttttgatgctaaatcagacaaagtgggtagcacttctgagtcaactacttaattatattactttgggagataatagtattaatagcaagattaatttattgcttcctttgttcttgagcactatatatcgtttttacactcatttaatttaattttcatgactacttcatagttctattttttttttttttgagatggagtctcactctgttgcccaggctggagtgcagtggtacaatatcggctcactgcaacctccaccttccaggttcaagcaattctcctgcctcagcctcctgagtagctgggattacaggttcacgccaccatgcctggctaatttttgtatctttattagaaatggggtttcatcatgttggctaggctggtcttgaacttctgacctcaagtgagccagctgccttggcctcccaaagtgctgggattacaggcgtgagccaccgtgcctggactgtagttctattattacgattattttgtagatgagaaaactaaggcacacaggagttaagtaatcttctaatagtcccacaactggtaatttgtagagtggggatttaagcatggaaagtatggctccagtatccaagattataatcactaccctatcctcttgaaacataagtttcttaaccaatggaaaatattttgctctgttggagaaaagatgtgataagtgtaaaaatgtgtagaaaaaaattgagaggactcaaactttagatgcaatcaaatgcattttgaaaaatctgaaacagtaagcatatgctacaatgtttgcaaaatgcgactatttcactgagatctcatttttacctaatgagactatttcatgaaaacattcaacaaacctgcttggggtatgtgctatgtgctgtttgctgccaggcaccaggggcacagagctatagacagaatgattttcatgtctgccctcatagaacttatagaacttacagtctagtggggcagacagatattaaacaaatacacaaataaatataattttaaactgtgataagtgccaggaaagaaataaactagattctttgggagatcttggggccacctaatttagacagacaagaccaagaaaggcctccctgatgaagtgacatttaagctttagcctaaaaggagatacaatatttttgtccaaatttgccatctagaagcagaatttgaggaccaaatcagaatgtgacttgtgaacaaaagacagattccttcaatgtcagaactgcacagcaacactgaatttcctgcgtatcctttgcttccctggaataaactgaagggctgcgttatactggttggcatttacataatgttcacagtgctcttgcttagaaccttgcccaaaacccatttctacctgtcaatttttattataatttgcgtattttttctttagaaacttagagaaaaaagggggattattgttcatgataaacactttggctctgaaataattaatgtttaagaagattaacaaccatacagttgctttatgagcaggggctcatgcttttggtaggtgttcaaccaagttcccagtggggaacttcagtctgggcatgtatttgtgtatttttcagtgtcccaaagcccagagtgcaatgtgtatgtggcattcatattgtgacaaacacagtcataaaaacactctacctacagcttcctaggaagccttcactagcttctctaatctaggttgatccatcccttctttaataccttgagtcacttatctttattacttaaaattccatggttggaaccatataatatagcccttatttatttttattatgatttccttgttgctagggcttcttttctccctgagtagactcagaggcctcgaaaataaggaacacggcttcttgtcaagatagaagggcctcattatacacctagaccaatcctctcattgtacaaatgagaaaactaagatccagaagagaagatgcccaaagactgaacatggggtttattacagacctgtgtctgggactcaagtctactaaccactaacccattgcttttcccactacaccacatcatcttccacagcacctaattgtgataaatacacagtaggctattggcaactactgataatgaaagcattttaaaatattcaacagaatgagaaagagctgtcttgccatctaaccccataacctcctgcagctccgctggcacttccaggctatgacagtttcaagagagaagcccctgaatcttaaaaactcaaggccatgtccacatttgattgaagtcaagaacacacagatctgttgtttctcattttctaggaagtcaagaacaaagtgtctatgaagagtagtcttctaattcctccaaaagttgcattcagaaagcaactaaacagaccaatcacatttgggagaaatacttctgccaggtgtgtgatccaacccagtcctgatgtttgctactgcaaagtcaacctgtctgcatggaacctgcctggcctctaatatgacaaagtcttagttttctcacaagatcataatcagaatgaatcagagccataacattatttccaggttcataaagcaccagagtttgcagaggtcacctcagagcacttcttcatcttcctgtgtagtaactgcctctcaaagacaaaaacaacaacaacaaaaacacgtccaacatcagaaagcaagttggcagaacatccagggctacctaaccccagaacccctcatttacaaatcatagttcttttcactgcattccaatgactccttcttaataaatgtcactgagtttcccttcagtcattgccccattttagttttcttgccttgatatttcagcatcaagctcctctttcttcacaagagaaggccagtcatcctcagcgtctttggggcatgggaacaatctctttaattctaaggtcaaactaggcacactgacagcagaaattctaaacttatcagtcacagtgcacattcatgacgattctctaaagtagtctgtctctgagaaagccatcatcattcattcatttgttctttcactccacaaatatttatcaaacacttacatgtgtcacattgttttagatgctgaggatacagcagaggaagatatgaacatggtctgtggctcaggaagcttactttctaacataggaacagagacattgaacagataattatcaaaataaatggcctccaggaaatactggttcctatgcaaatgaataacaaagaaaacttgtccagttcagacagtcaggaatggttgttctgaaaaactgacacttaactaaactgaaagaagaaagaagtcacccaggggaaagaaggacaaaagcattgctgagagagagagaaaaaagcatgtgtgaaaagaccaaagcagaaagcaagctggtgggttttagtaagtgaaagaagaccagggtaactactaggggggaaacaaggaaaagggtgatgtacaaggaggtgatgggcagggaccagatcatgccaggccttatgtgccatgtgaatgaatgaaagacattcacacggggtgaatgtgaatgtctaaacccaaagaggttgagaagcctttgaaaggtatcatcagagaagtgatatgatcagatttgcagttttaaaagattatgttggttgctatgaaagtaggcaaaaaagaatatgggagagaccagttaatgagcaagtctctggtaagagaccagataagaaatggttgtgacttggtggttggcgcacatgtgaagaggtggggagagggagagtctacatgtttatgatgtgagcaactgcgtgcttgatggtgctgtttaactaaatagggaatataaaagaagcaaccaatttataggggagagatacccagaaagaacaggtggatagtcaggtctggaacagaaaagaggtttgactgggagttaagaccatgagaggagattatactttgatgcaaggggatataaaagaggactaggacagaatcccaagaagttctgatatttaatgacctccagtatgtagaagccttcagtgaagcctcatatggaacagagagaggatttcaagaaaaatagagcggccagtcatgtcaaatcctgctgggacgtcaagtcagtagaagtataaaagtttatctggaattgtcagcctggaggtcatttgcatcttagcaaaagctttggtaaagaaaactgggagagacatattacagtgctttgaagtgcaaaaacatgcattgatgtatttttcatgtatgacctttgtgacattacatcacctaattaaacctgtgacctcagcatccctagaaaaccttaatcagttattaaattgattacccaaattctactgtccaccaaaactttataaatggcaaataattatctacattagtgactttagtattcttcctgaatcaaaactatacttcatccttaaaaatatttggcttacttaaatataactggtaatattaatccacagctttaaaaactgtaagaactcacactgttttccaggcctcttcctccaagaattcgaaaggaatcctgtgatatctgttaaggatataataggacgaaaatttggggtaaaggggaaattcgaaataggagaaaggaacacggcttcttgtcaagatagaagggattatacacccagaccaatcccctcattgtacaaatgagaaaacttttatttggggcagctgaaccatattcaaaagtatttacaaactaaataaagtggaacattgtaaattctttatatttaatttaatttaattgcaaatgatctcacatgtttgttttgtttatacactgagagctagtggtgtggaattgaaataggctaagtggctattggctattaaatcacatatgtaatggaaatattaaggtctatattatgcatttgtctataatttaccttacataatgcttccatatacattatttgattttcctacagtgtcagataagtagggccgaggtaatcatctccagtttacaaattacagaaatgagggtcaaagaattcaaaagacccagatagcatcagaactcatgcttcctgtcttcgagtccagtggctatttcaacaaaaccacactatctctctggttttttaaaattattataactcaaggtttctgtagctgactcaatccaccatcctgagttttttggttcacaacactttcagatcatgtgataaggaacttcttttcttcctttgacacaaaaatttattccttctttctgatcccattctcaatgggttggaagagatgatacggaggtaaagactcaggagaagttaagatttatcctcctcatcttcgtttggatctccattctggtgggcagagctgttttaagtgccctattaggcactttcttctccaaactccagctttctttcttgaattacgctcttcttcccttttagcaccaatataaatgcacctattctcagcatttcagcctgacactctcattcagcactacaaacagatcaatcattcaccaagccccacagaaagccagtcccattcagctctcacccattccttcctctcttgttcagtaccacggtcagctcaaatccagactaggcgctcactagctatttcagaaccatggatagcgcacgcactttcgtccgccctgtaaattactttggtcctgctccaacaacagattacctagctattatctctgagatcattcataggtgattcagttaagcaaggatttccctaaccccattctttgttatcagaggcaactcaggattattcaacttcaaaggtagctaagtgctatttttccagtgtcacagattgctgagactaggtctcgaaggactgggcaggatcatgtagagtgaggtctggtctcactttcgtcaccacaaacagcttatcacactttcttagtggcttatctatttcaaatgctatatctttcctagacagcttactcatatgtccggtgtcctgttgctcccatcagatgtctaaagattaaaatttttgaggcaatggacagcttagcttgacacatatcagtatcactggctgtatgaaatgcttacatcttggagacaatcttcttaaagtcttgaccagtctggtcacatctgcaaaaccagggacatttaatctcatgctcacgttgccatggagagcccagcaatatcttcagtgctaaagctagcttggttatttgttccatgtattagagaacctaatcacactctcagcaccatgcataacacagtttcactcagacataacagtagttcagttagtatttctcagcaccagctcagtcacactttcacccagtgctatgaaaggtccaaccacattctcagtcctagtaacatccttacaatatgctccttattctgccaagcagctaagtcataccatgcagataatgaacctgaaacagttcattatcatggcctgttcttttggtatctcttataattagcttagtcatgtttgcagtcacaacaatatcccaaacaccctcttccagcaattgagaaatctagtcacatcctctccactccacggtacttattcacactccctctgagtctacatgactaaaatcattcccacaactagaacaagactcagcagttcttgaaacttttctttctgctgtttctatgacactgacatatcctttttcttctccttcatttttggctaccgcatctttgtaatattcagtgccattccgcccccacaaccctcctggtttcagcctttattgttcccctctcactttggagaacgacttttatccagatcttggtggattttagtaagttgttattgaacataagacacttgtcttttcagtaacctggattatggtcagtttctatccaccctggactcacaattcagctacatgtgcttcctcttccctgtgttccctaaactcaatttcggtgtcaggtgaaaagctctttttataaatatctgatacatacccatccagatttcttgaatatttatttattcaacaaataactgttgattacctaaaatgtactaaacattattctcagtgtttggggttcaacagctaagcaaatagacaaaatctatgctttcatggggaaaacattctagctgaaggagataaataatgaacaaaaatgtaaactattaggtcgtaaaagtgttatgaagaaaaatgaagagagagttaaaggagtacaaagtggccaggggctgctgtttgggaaaggatggtcggggagtcttctttagcaaggtaatagttgaatgagctatgtaattataaacatgaagagaatatgagcagagaaaagaacaagttgaaaaacagaggcaatattgtgcttggtgtgttcaagaaacagccagggaagtctgtgagactcggttccaatgaacaagcaagagaattatatgaagtgagttcagagatgaagttatgggaacacactacagggtatatttcaaaagtgccattctgattgctacagaaactataggcttcaagtggttgagagaatgctagcagtgagataagttaagaagatataatagcagtccaatcaagagctgatggtggattggactgtggcagcagcaatggaagtgggtgatagtggcttgggctacatggttagcagtggctgtgatgagaattagacagctatacttcagaatcagagttttctgagagactggatgtgagatttgagggagagaagtaatgggtaatttaaaaggttttgttttttttatatactttaagttctagggtacatgcgcacaatgtgcaggtttgttacatatgtatacatgcgtcatgttggtgtgctgcacccattaactcgtcatttacattaggtatatctcctaatgctatccctcccccctccccccacctcacgacaggcccagtgtgtgatgttccccttcctgtgtccatgtgttctcatttttcaattcccacctatgagtgagaacatgcagtgtttggttttttgtccttgcgatagtttgctgagaatgatggtttccagcttcatccatgtccctacaaaggacatgaaatcatccttttttatggctgcatagtattctgtggtgtatatgtgccacattttcttaatccagtctatcattgttggacatttgggttggttccaagtctttgctattgtgaatagtgctgcaataaacatatgtgtgcatgtgtctttatagcagcatgatttataatcctttgggtatatacccagtaatgggatgcctgggtcaaatggtatttctagttttagatccttgaggaattgccacactgtcttccacaatggttgaactagtttacagtcccaccaacagtgtaaaatttttcctatttctccacatcctctccagcacctgttttttcctgactttttaatgattgccattctaactggcatgagatgatatctcattgtggttttgatttgcatttctctgatggccagtgatgatgagcattttttcatgtgcctgtttgctgcataaatgtcttcttttgagaagtatctgttcatatcctttgcccactttttgatggggttgtttgtttttttcttgtaaatttgttggagttctttgtagattctggatattagccctttatcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctaaatggtattgcctaggttttcttctaggatttttatggttttaggtctaacatttaagtatttaatccatctagaattaatttttgtataaagtgtaaggaagggatccagtttcagctttctacatatggctagcctgttttcccagcaacatttattaaatagagactcctttcaataatgggtaattaaaaagttttaaggcttgggacctaagttactagaataatgaagttacaatgtgttaaaacgggagaaggctaaggaaacagtatattgggagttaaatattataatttcactttatacttctgtcagacatctgggtggaaggtgatgaatagacggctgaatacaagaatttggaatgcaagtgaaagacttgggctagagatataaatttaatgtttcaaatgtggccacagactacttaggttgtcttcataacttcagcccttttctcctctgaaaagtaagggtctgggaagctggccagattagttgactgaggcccagagctatatttaagctcccaaaggttatggacctatagttcgtgtactgctatatctccagagtgtaaaaaagtgtctggcacaagggaggaagatttgaggaagcataaaggaagactcctaagtttctatcttggaaaaatggctatgaagtttattgagatagggaacacagaggggagagaagcttgattttggtggaggaagatgatgagatcatggaagacaatgattttgaggtgtttatggagcattaaaggggatatgtccaaagacagtgggttagcatgactggaactcagaagaaaggtctagattttggagtcacctacatgaaaatgctaaccgtagttgtatataagtagataagagcaaccacgggaagtatgagaaggtacaatcctacacaggtaaaatcttacacttttgcttactaattaagttctggaaaaactataattacctgtttatccacatcatatctactatacagagtcaaatgctacattagtagggaaagacctctattgggttcttaagacctcagtgagttacaggacaaaaaggctgttctcagaggccccttgaaatctcaccaaatctgaacacattcagatcagttgctgcctctctcaagtcccagaactctccaatggtgccccaatcagtagcattccagacctgctgtagtcagccagacctgccccagagattgtaaagctctgaatctggaatcaaaagactcagagataagcttgttcagtccaattaacatctttatatcacagtaagcacagaccttcattggttcttagttttctcttatttaagagaatgcctttgacctactgtacaggatttctgtggagacaaaaagggataattatgcagaagcactttgtaaactcactgtacataatgaggtgctgttgttactgttgtgaatcgaggatttgagtaattcacctcatgaggcttagtcatttctgtgatcagactcaattagcacacactcaggagatagcgagtttatgattgttgtgtaatcagagaaacatcctgctaagatctacaaaatctggtcggaagaaccctctgtcttgccttgcccactgtaatctcagggagaccctcactgtcacccttattcacaccagcctctaccaagcagctctgagtcagctggttctcccagaacataggtcttaatcaaagaccaaccatagctatttccatcactatcgaaatggcaaatgtgaaacacctgttatctgttcaatcacatttagtcttcttcttagaaactgctcactcatcagatctcagaaattcaagtcaaggtgctactatagcctatgaagaagagacccagtgggtcctcttgtagcccagaaatctcaaaaacagggtaaatatctacagaaacttgatcctcagaaataaccaaattccactctgttctcattccctggatgtaagcttcctgaagttcctggccaggagttgccctgattctgacaacaaaaggcaggaagtcctaaggactgccccaaaaaaacctctggggagtcagagtttcctagaacgaataagaatacctgccacttggtgccaggtctctttttccaaaactccctaatactggcttctgacctccaaaatccagaaagattttcatccaggccctaagactgtgggagtagatcatggcttcaccagattctataaccttgtcctgtttcacctcacagttgcagagaatttcagtgcttctcaaagggacaacacctttggaagcttcagttatgagtctgttaaaaatggggccccctgggcctcacctcagacctactgactgagaatcttttcaggtggagtccaggaatctgcatcttagtccaattctcccctgtgatggtgacacagctagctcagcaccagactgtggactggcatgtgaagttcactgtactagagaagctggaagagctgttatccacaaagccagtggttactgcagagaactaagaacatcaatgtctgttgtaggagctttggttctagcttctctaaagcaagcagaaaaaaatccacatagatactgctttacccatctgtgatggcaaaccatcctgtttacctccagactagctctagggctgacaaactttctgagaatagtgtaacccataaagaacttagaaagtcaatggactgccttttaggggttgcctggaccatgatggaccagggatcccagagaccctttctggaagcattagagaacatatcttaggacaagattttgcaagcttataggaccagcgaacaattttaaaatcatcatgcactgttaagtcatcagttggccctcaggagatgcaagacacacttgaagtaaagtaacacagccaacatggttccatgaataaatcacctgaaaaaattatcaaaaccttaatcatatgatttttttaaagaaaaactttatatgagaagcaaaagtaaccaattagggaaattaaataatttgttttattaagaataaaaaactgcaattatgctgccaaactgtagagcatcaggcagaagcacgttctcaattagcaagtacagccatgtattcaaggagctgggacttctcctctatctccctgccacgttcaagattggctgtcacttcttaaaagcataccattacataataaaaagaacaataaaacatgttagtgtcttctatacttttcaacaaatgtattacaaaggggaaaattttacctacattatttttcccagaggacacttgtttacaaattctgcagaacacattggggaaaatgcaaggttagacagtcctctctgaaggctctgagccaatacccctataactgatcagtcaatgtgagtgatgggggactgcctgtgagaggaatttctgtaggcctgggtctggccctcaggatctggggccagagagggaaggaaagcattggccctatagctaatctgttctgccatcactcaggttagtattcagagatcctacaggttctgggagacatgggatctttagagaagaacaatagagaaagaacccctcccacctgatattaagaaggcaaaaggggctgggcacagtggctcatgccagaatcctagcactttgggaggctgaggtgggaagattgcttgagcccaggagtttgagaccagcctggggaacatggaaaaaccccatcaaaaatatgaagattagccaggcgtggtggcacatacctgtagttccactacttgggaggctgaggtgggaggatcacttgaacatgggaggtcaaggctgcaatgagctgtgattgtgccactgcactccagcctggacaacagagtgagaacttgtctcaaaaaaaaaaaaaaaaaaaaaggaggcaaggggaaccaaatatcgctgttggttcatcttgggagggctgaatgcccaccgaatagaaaggcttgcttagcaggaacagctattaaacttaagggaatatacctgcaaaaactcatgcagactgtttgaaagccagggccgagcttggagctaaactagaatagatatttcttggattgtctcctcctcagccattaatccaagaagtgagtatcaggcccagactaatcctataacacatacatttgatatggctacctcacaaaggatgtgctttccccactacattcaactagactctaaaatagggattcccaattaaggttgcaaggactatagccgtcactatctgcaccttgctcatttcccagggatctagaccagaggtcaccagcagacacttcctacatgtgacttcctgcctctgtctgcccagggctttctctggccactgaagtaagttctgtagagttaaaatcccaggacaaccgtcaaccaataagggacaggactggtagataaaaccctagtatccttacccctcagtgaaacaattctgagcccagtttgcccataagagtaaatggctcataaaaatactgctttcttcttcttatgttacttttcctctcttctatgacattcctagaaatagctctcagataaactacttgcaccccaatagttttctcagaatgtcatgtaaagacactgggtaatagatgggaatatagagaaccacttcaatcaagggatcccaagtccagagctatcacttctgatgggaaagtcttaaaagaaggactggtccctcatacctacatcacatcactacaaattcccaccccaatgttgaaaacaattttgtccttagctggagggatttatggtagcccagaataattatggtcatttggcatgaagtcagtctcatagctgagtctgctttgacctcaagctccagctccaggacctggaattctggcttagtcctgttctcaatcctcaacattgcattccagtgtcactgagagaattcttgcattgttactaaacaactgagtcctgggattcaaatttggttccaaactataagtatctcttctcccctagacaaggaagagaaagttaacttaatctttgtttctcagaagggaagaattaaagacactgaagtcaacagtgtttgaatggtcattgcataaatacaccatgttaatcagaatttgggcacacaacacatagaacttctaagttagaagaaaatagaagacagatgttcaattatgtaatgtaggttgactttgaaaagttccgtaagaaacagatcaactacaaataggcaggaggagaggaagagggtgagggaaagctctcagaagaaagtaatggaggacattaaggaagaggaatggtgtcagagcagtgagtgctcctcccaggacttcaatgcatggaaggactggtgacaaccagcagagcctcctacatatgggtattgggtaccagagctgcctctagggctggtgacaataagcagtgtctatatcacagaggtattggattcaagaaatacctctaggtatggtgggagcaagcaggatctccatcataggggtatttgatttaagcactgcctctgccaccatctgcttgactttggggtgtgtgagctttaaaatgtcaatagactcaataatctctttggttccttatattcctattattggatctgtgatttttgctgcatttttctgaacaaaatgttctttagtttttcagctattaagtttcgccattatctctattcatgcaacaactatctattctgtatctagttagttccaggcactgtactaggttctggaaaatcaatgctgaacaaaatagatgtgagtccagctctcactgagcttacaatttggtagaaacaatagaaaggcaaacagaaattacaaatcagatgtttatagagaaagtgcagagagttatgggaacatgaaacaggaatcctaacatagacttcatataggtcagaaatggaagaaattgtctcaaagccaagagtacaagaataagagaggattagccagacaaaataaagtggaaagataattttaggcaaaggaaggggaatatggaaaagccttaacataaaaaagaatgggtcaaattcaaggataaacttataaaagtagtgtggctggggactaccatgctggagaggtcagcgcacagtttgggttatcttgagtgctatggagagctttagaatgattttaaataaagatatcacataaccagattttcattttagaaatatcatttggccactgttggagaataggttagaaaggactaaaggggaatcaaaatgacacatacgaggccagtgagatgacagtgattggaccagcagtatgatggagaggttagagagatatgaagagaagatattaaggaggcagaagcaacagcactagatgtttgattgtatgtggaatgaaatagaaagagcataattatggtacccaggttgtggacagacacagaaacaggctatttggggctaatggcagtaaaaagacatagaagagaggcaggtattagaaagaagtgaggagataattatgagtttagtttggggcatgctgagcttgaggtgctcatgagacactgaagtggagagatcaaatgaagatctgagccccatggacttctgagagctacagataaagactcagtcatctgcatataaatgagaagtgaagatatgggaatgatgagatgtttccaagagattgtggcaaacatacctgagtttaagtaccgttctgccactcattagtaatgtgatcttggaaattttaactttgctgctctggtatcttatttatatattagagataatacttcacaggtacagtgatagttaatgtaataatgcatgaaaattgcttaatccagagtctgaaatacagtggaatctcagtaaatgctagcgctgttgaagttgttactattgttattattctgaaaacaaaagatagagtgccattattcacaatcatgtatgggaaaagctgagaaaggagagactgagaaggagaagagagaaagttaggaaaaccaagagagtgtcatggtagccaaaatatacagtattttaaggaggaaattgtcaaaacagccaataggaccatcaagataagaactgagatgggcctggacaatatagtggtacactgcctacaaaaaaattttttcaaaactagccgagtgtggtgacatgtgcctatagcccagctattcgggaggctgaggtgggagaattgcttgagcccaggagacagaggttgcagtgagcagagattgcaccactgcactctagtccgggtgacagtgataccctgtctcaaaaaaaaaaaaagaaaaagaaaaagaaaaaaacaaaaaagacaagaactgagaagggccccctgactttagccacaaggcaatctcttgtatccctgcaaggaagcattttagtgagataggagggcaaaatccaagcttcaaagactgaaaagtgactggaaacagtgagtagaagtaagtcctttattaaaagccaatagagaacaggagagaggagggaagacctggatgggctctgcatcaagggaaagtttttaaagttggaggaaagttaagcatctttaaatgctgataggaaagagctggcagacaaggagagagaaaaaaatgaggtagatatgagataagatcctaagcagagggaaaggaatggtccttagaatgtaggaagatacctctcatgttgtaagagaagggaaggaggaaagaaggctgcagacacaggtgagttggaggtttgatggtatgaagttggcagagttctgtttttctccatgaactaggaaatatggtcattggcttactgcaagggaagacagggaatagtgagaaaagagtgtatttgaaacctcagactagaagaaactgctgactagggataccatatgattcccaggcaatactgaggttccccataacccctcagcagttcaggggaactgttctagattgacttagccttgggatttaggataagggtgagggagtggcaaaattgtggaccacaggtctaatctggttatggggaaaagtgttcagccacagactgaacctggaggtcccagagaaattggaggtcccaatgaaattctccaataatctggagttctccagtaacttggaggtccaaatgaaattcaaacaggtggagaaatgttgacaatgtcaataaataaaagattgtgataagaaagtagcatgagacttaagataaagtagactataaaccaaagtctttgatgaatatgggagagtgcctggaactcagtggtcctggaaatgaggagagagggcagcatggctaaatctggtggtggtggtaggatggtacaaagtggtgaagaagcaatgacatagaagcacatggggagcaaagacataaccctgaggcacctggaggagggttgaataaacagcctcccctgaatgccttgcaggggaatgggttcctgggaggagccaagtgtgagttcagggaggggccagatatgagggtgggagaagggctgttctgacaatcaagatgggacagatgagagggacagggccagtgggcaagctgtcacctctctgtggttatgtccactcttataagagtataaatacttcctgaagaagaatgagaagatggaattccccattggatccctcgaaactaacaacttccgtcgctttactccggagtcactggtggagatagagaagcaaattgctgccaagcagggaacaaagaaagccagagagaagcatagggagcagaaggaccaagaagagaagcctcggccccagctggacttgaaagcctgcaaccagctgcccaagttctatggtgagctcccagcagaactgatcggggagcccctggaggatctagatccgttctacagcacacaccgggtaagagctactagtaggaatgtctgctctcagctcttggagaggaagtctcggtcccacccagcccagaaagtcctccttggccctgggtgatgtggcagtctgctaaagattccgttaacaaccaaaaaaaatatatatatatatctctaacttatttgatgatctctttgaatttttatgacatttatgatagaaactaactaaacccacatcttcaaaagcagataactgctgcagagctttcagggaaagttggctgttcccttggatgacctctggcctggggcctccagaggagttgggtctctttgcaggtggagagcagacatcttgaggttgggggaggagcatggcggtgaggacagaaagcaggatgaatttaagccagtggtcctcaactatgatcttggaacccctggtgtccccaaaactgttttagtgggtttataaaatgaaaactattgtataacaatacttggatgtaatttgtctttttcacacactttctcttatgatcatacattggtgaatatagaggctattgatgggggatgatgtcatcactctaaaagctactggaatgtgtgcctgtatattcccgtgttttaaaatttcctgagttttgaatttctaatatgagatatatatacacacacatatgatgtatatatgtgtgtatacatctatacactatatatatacatacaactatgtatatacatacaactagaccatgtagctagttatgtatatataggtatataagcatatatacatatatattaatttctaatatgatatacatatatctggcataaacaaaaaggtatcaacataaacaaaagttatttggggtcctcaataaggtttgagagtaataatccctgaaatcaaaaagtttgagaatcagtagtttaaacaagagcttcttcatgacaattatctcacctgtgttgtatttttgatgttctacgagccaaaaaatggtgaatgcatgtttgggagttaggaggacaggaatcagccatctcaaatatggctagcagagtaaataaaaaggcactgaatatctttcttcctcctctcccatgccaagagttcatatcctcctaaatcctcagagggagaaaccaggagaggatttaagagacagagatgtagaaggtggagacagaagaaacattacaaaacaaggatggttctcttgtcagaagagaaattaaatgcaaccataacttcaccatcctgttgccagagtcctcccctgggcataacacctcttaccagcctgaggattggctgtctgtccattaaagtaccctcagtgggctcatcttggtgcactgtcagtcccagagatgaggatcttgctgagagggtgaggatatggcttttagtccttgatcctctctgcctctctgtacctgcatttgactctcattgacctgtagttcccagagcccttcttgctcataagcctgagataatgcctctcatgtttaaaaacatggttgtataaggaatcttgtttctcattggaggtccactttctgttttgttttgtttcagacatttatggtgctgaacaaagggaggaccatttcccggtttagtgccactcgggccctgtggctattcagtcctttcaacctgatcagaagaacggccatcaaagtgtctgtccactcatatcctttgcacgattgcctcttccacgtgttacaattagaccttgcctactgtgtccagtaccttctttagaggttagcaacagagcccttatccaattgaatcccaaaagtacaatgaggtcattagattgaaaaaatggcttgggcctttaatgtgtcccacaccccaaagcagtcccaagacacagaagaagtgtttatgcaacacacaggtggtttggattcacctcagactaatctagacacacctgtggatgcacaacttgaaaaacatcctctttatgaggggaggtttgctgatgcccccagacacattctcaccacggtgtgtggtccgctttccccacaacacaacaggcagtaagagggcccaagccttctttgggcagatgagataggcatgagttgttgctctgtgccatagccatgctgagaagtggctgcttactgggcaaaagagcagcacctcccagagggcaaggaaaacagaccatgatgggaagagcacacatagtctcaatgggacctcattggtcatggggcactgttaacatcacaaattactcaaaaactactagcaggtttaaaatgtcaataatctgatgttcatgccatacaagactgtaatgattagagacacattggtcaaatgtctactatatgaattgttttaggtaatgtcagaagctgctttcaggggattttgcaaggcaagccaaactagtagaaaaaagatactttggtttggtttcctaagatcttcctgggtgatcctaatggaaagatcctaatgacctaagatccttggtcatcggaaggattggaagttctttatgacaaatttagccctggcttgcaggaggttgatgtacaagaatacacctgcctcagttgcctgacaaatggtaaccagccttttcttagaaggcttcagtaaaaaagagttctaccctgctccctaactctgaggcagattgttggatttctggacagttgtcattgagctggtaaccttggcacagtcatctatctgcacactcaacatgaagctgcacagcttgatgaagttgcattacgttttctctttttacatttttttctttctggctggccagcaagaattacgttttctgagctgaatcttgaattttcagattctacagaaggatatttaatgacaatacagtctctcacttgctaaatacttcctaagtgtcaataccatcatcagttcaaaagcctctgaagtagagattaccatccccattttacagataatgaaactgacacacagaggcattaagtaaattatccaagaccatgtagctagttaagaagtccagcctgcatcctgcgtagagcagtatctacagtgaggaagtagggtggaaagtaatcagggtaattattctctcaatgtgtcgtctctgcttgggtagttgttgctttttcaaaatatatacaattacatggaaattacaaataaagagaaatcacaaacatacaaactcctctttatggattctggttgaattacatctggataagtaagaaacagctaattagaaataaaatcccctaaaaagaaccaagtgaccagtgaatattctcttcatcttgagatttgatgagtaaataattgcttggtagagtcacagctggacagaaaagctgttgagggggtctcttcctcacaaaagtctgcatttaaatctcataaatttggtaactccagccccaaaagatactagaattctcagggccctattattaatatttcaccaaaaatataattctaatcacatttgctatgaatgttttcataactaatattatacataagatatattacttttaaatatttgtagaattggagacacgattttagtttaatccttggattaacatttccccccatgtgagcatatttcttaatttaattgtaagtcagcaggaaaatgtggtttaattaatagaattttccttttcataatagatgtgttcctaagtaactgtaaaactagacacatcaaggcatttacagaaaactaaaatacatttaaatacttctgctcaaattgaaaaatgagtgttgtactctctctgtaggtcaagtttatcttcaagttttatttttccttaggaagcactgttgggagcccagctattcctaagaaaaatgtccaagtgggaacaatttacctttagattctccccaccaacatttcttcccttctattttccccttccacccaccttcctttcaatgtctccctccccttttgataatccctttgcccatagtctgctgtcaatattctccactctagctattcagagttctccactccagcctaatcctacttggggttttcttcctgagccagtatttcatttccctgtgcctgcctccaccgttcctacccagaagaccatttcctcggtggaactgatctcaactaagttacccaaacaatctgatgaaactaattcccatgaaagtttgtacctcttcacttatctccaagtttctaacttttctttgtcttttagaataaaaaagacatttgccagatgaaatttcaggccattttgtatactgaaatgaaggcttcggggcagaaggacattttggaaaagggagtctgtttccttctatcttgctcagagtttgttatcaaacagataagagttcacatctctgcagcatggttgactagctgcatgacctgagaaaagttatttaacttttattttttgtcagcctgtttctcagcttcaaaatgtagatatttatacccacctgtagatcagttgtattagaagtaacatggacaaagtactcagcctagcttaggcactcagtaaatgttagtggttattatgtgacaagatcataaagctaatattggctaagatttatgaatgtaatcattcagcatcaaggtgatcctagatgacatcacagagacttggtgatctcagcttttccttaacacaggcctttcaggtggttcagtttatttattacggtcactattttggttaattgtgtgtgcatgacccgaactgaccttccagagaaaattgagtgagtagatttgctatcattattgtaccatctctttttgctttcttttcttccttcacttggcagtctttgtcttttatttatcctgccatgcctcatgtgggtaatgctgaatctcattgtctatatgtctttgtaataaccaggtctctccttctgtgagatttgtttcataaacatacatgattttcagtttcaaagagatacagattagtggttctcaactttggctgcatattgcaatttttggggagattttttaaatgcctgagtcccagccccagaaagtctaaggtggcctgggaagatgagtctcctcgcccccacccccccccaacacacacacactcactcacctgctagatgcacacacaaatgtatgccttagagaaggtatgcttttgagaaggcctgctatgaaagagagacaggagcaaaactgagacagaactaagaacaaatggctctggagtatatttagaaaataactcataaatgaagctgtttaagttatcatgcttcatatgcctcaaagtaaccttagtattcctgaagttattctatttccctaggttagtgggtgaaacccctatagtttcagaatctgggagttttccaaaaacattccatatccacacatctgggagggatgcttccactccagcttgaacctaacatacctttggttataataacaggtgctttgcagagctttctttttttttttttttttttttttgctaatcataacagtaatgcatgccacaacagaaaatacgttatatttttattaatagattaaaggaaaaggatcacatagtcttcttaattgatgctaaaatcatttgataaagtttaatttccatttataattttaaattcttagaaaagttgaaatagaagggaataaatgtggcacatatacaccatggaatgctatgcagtcataaaaaaggatgagttcatgtcctttgcagggacatggatgaagctggaaaccatcattctcagcaaactaacacaagaacagaaaaccaaacaccgtatgttctcactcataagtgggagttgaacaatgagaacacatggacacagggaggggaacacactggggcctgttgaggggtggggggctaggggagggatagcattaggagaaatacctaatgtaaatgacgggttgaagggtgcagcaaaccaccatggcacgggtacacctatgtaacaaaccggcacgttctgcacatgtaccccagaacttaaagtataataattttaaaaaggggattgcatcactctgataaagggtattcattgttttaaagtatcaagcgtcatacttaattgtgaacatggaaagctttccctttgagatcaaaagaaaaaaaaaccaaagatgtctgttcttctcagttccactttgtaaaggaggtctcagccagcatagtaaagcaaagaaaaaaaaagtgcaagaagaaaaaagtaccgaagatgtaatttacagataataagattgtatacataaaatatccaacataacctagagataaacagtaagaattaataaaagagtatagtaaggtagctgggtacaaattaacatacataaatcaattgtgtatagacactagcaacaaacagaaaatagtttttaaaaataccatttacactggcattttaaaatgtcaagtatctaggaataagattatcaaagtataagtgagatctctataaggaaaattataataagtattgtgtaaagtttttaaagaaaaccaaatcagtggggagacatgttctcagattcaaagtctcaatattgtaaagactcccaaaaatgattaataaatttaatatgatcctcaaatcaatatttcaacaggcttcttttggtattacttgacaaactttaaactttaaattttcttcctcaaaagtttacatgaaattttaaagagcaaattatagccaagaaacttttgaggaagaaatacaaagtgggagaactcattctactggatgtcgagatttactataaagctctaattgaagcagtgtgccattggtgtaagattggtcagaataatgtaacagcatagacagtccataaacagaccaacacatatgtaaacatctaatgtgtgaaaaggtggcaccccagaacagcagggaaaaggcggtcttcaaaaaatgatgctgaagaattaggaatctcactggaaaaactacattaaacatccaactttgcaccacacacaagaatcaattctaggtggatcaacacctcacttgctttgtgaaatgcaaatatataaagcccttttttaaattttactttaagttctggggtacatgtgcagaaagtgcaggtttgttacataggtatacacatgtcatggtggtttgctgcacccatcaacccatcatctacattaggtatttctcctaatgctatccctcccctagcccccaacccctcaacaggccctggtgtgtgatgtccccctccctgtatccacgtgctctcattgttcatctcccacctatgagtgagaacatgcggtgtttggttttctgttcttatgtcagtttgctgagaatgatggtttccagcttcatccatgtccctgcaaagaacatgaactcacccttttttatggctgcatagtattccatggtgtatatgtgccatattttctttatccagtctatcactgatgggcgtttgggttagttccaagtctttgctattgtcaatagtgccacaataaacatacgcatgcttgtatctttatagtagaataatttataatcctttgggtatatacccagtaatggaattgctgggtcaaatggtgtttctggttctagatccttgaggaatcaccacactgtcttccacaatggttgaactaatttacactcccaccaacagtgtaaaagcattcctatctctccacatcctctccagcatctgttgtttcctgactttttaatgatctccattctaactggtatgagactccatctcattgtggttttgactggcatttctctaatgaccagtgatgatgagctttttatcatatgtttattggctgcataaatgtcttcttttgagaagtgtctgttcatatcctttgcccactttttgatggagttgttttttcttgtaaatttgtttaagttttttgtagattctggatattagccctttgtcagattgatagattgcaaaaattttctcccattctgtaggttacctattcactctgatgatagtttcttttgctgtgcagaagctctttagtttaattggattccatttgtcaattttggcttttgtcaccattgcttttgatgtgttagtcataaagcctttgcccatgcctatgtcctgaagggtattgcctaggttttcttctagggtttttatggttttaggtcttatgtttaagtctttaatctatcttgagttaatttttgtgtaaggtataaggaagggatctagtttcaattttctgcctaaggctagccagttttccccacaccatttattaaatagggaatcctttccccattgcttgcttttgtcaagtttgtcaaagatcagatggttgtagatatgcggtgttacttctgaggcctctgttctgttccattggtctagatatctgttttggtaccagtacctcgctgttttggttactgtagctttgtagtatagcttgaagtcaggtagcgtgatgcctccaactttcttctttttgcttagaattgtcttgactatgcgggctcttttttgttccacatgaaatttaaagtagatttttctaattctgtgaagaaagtcagtggtagcttgatggggataacattgaatctataaattactttgggcagtatggccattttcacaatattgatttttcctatccatgagcatggaatgtttttccatttatttgtgtcctctcttatttccttgagcagtgatttttagttctccttgaagaggtccttcacatcccttgtaagttgtatttctagatattttattctctttgttgcaattgtgaatgggagttcactcatgatttggctctcggtttgtctgttattggtgtatgggaatgcttgtgatttttgcacattgattttgtatcctgagactttgctgaagttgcttatcagcttaaggagattttgggctgagatgatggggttttctaaatatacagtcatgtcatctgcaaacagagacaatttgacttcctcttttcctatttgaataccccttatttctttctcttgcctgatcgccctggccagaacttccaatactatgttgaataagagtggtgagatagggcattcttgtcttgtgctggttttcaaaggaaatgcttccagtttttgcccattcagtatgatattggctgggggcttgtcataaatagttcttattattttgagatacattccatcaatacctagtttattgagagcttttagcatgaatgggtgttgaattttgtcgaagaccttttctgcatctattgagataatcacgtggtttttgtcattggttctgtttgtgtgatggattacgtttattgacttgcgtatgttgaaccagctttgatcccaggtatgaagccgacttgatcgtggtggataagctttttgaaaggaaaaaacaaagaggaatatctttatgacctcagactaagaaaaactttattacatatgacacaagaagcactaactatacaggaaaaaactgatacattttagtatactataattaagaatgttcatcagaagacaactttaagagcatgaaaaagcaagtgcttatattcagagtaatgaactctacaaatcaattagaaaaatgtcagaacaaccacttgtaaaatagcacaaaatttgaataggcactttacaaaagtggaaatccaaatggccataaacatatgaaagtattcttaacctttttttaaatcaaagagttgcaaattaaaatcacactgagattttattacatgttcatcatagaagggaaattttttaaagtgtcacaataccaagtattgggaatgacatggagcaacagaaactcacacactgctggtgggagtgtaaatttggacaacctctttggaaagcaaggggtattatctagtaaaggtgtaagcatacatatgctgtattcttctattacacccttaggtacctatgtttaacagaaatatgtacttgtggacaccagattacagctacaagaaagtttatgaacatttgcccataaaaaccccaaaccggaaaccactcaaatgtccataaactttgagtacattaactatttctgttatattctaaaatgagaaaacttacagcaataaaaattaataaactttagtgctgcacaacaataaggatgagtcttaagaaagtaatattgaacaaaaaaagccaaatgcaaaggattacataaacaaggttcatttatataaagtttgaaatcaagcaaaactaaactattttgtttaggaatgcatacttatgaagtaaaaagcatcaataaagtaaggcaagaaaaagtaccaaaaattaggagaatagtggcctccagggcagaagagggaggatgtaattgggaaggagctggtgaagtgctggtcacgttccattttatggcatgggtagttgtcacacaagctgctatggagtgaattttgtcccctcaaaattcaaatgttgaaacaaaccccccatgttgctatgttggagattgggcctctaaggaggtgattgggttaaatgaagtcacaagagtagagcccttaagtggtagaactggtgtccttataagagaaagagacagctttctcccctttgtgtgagaacacaaggacaaggtagacatctataagctagaaagagagtctttcccagacccaactatgctgacatcccaatctcaggcttcaacctccagatttgtgagaaaataaatttctgttgcataagccacccagtctatggtattttgttaaggcaacaaaggctgactaatacacaaacatttgttttaaaataattaatttatgttttatgtacatttttattatgcatgttacatatcataataaaaacccaataattttttaaaataaatgaccattgcaaaaaatgcagaacactgaaaatataaatcagaagatggttactaagtagagaaatcacaaaatcatgaaattatatttaatattgttgagatcatatagcatgtaaaatgtctatgcttcttttggagttttaatgtaaaacatttttttgcaaaatgagttatttgggagttatttggagattgtggttaaatatggaagatagaatgcatatgttttaccccaccctctcaaaatgccaatagaatgacagcacgggggaaagaacagtataaatatacaagaacaaagagaaagagaatggaaaacacagaggacaaatgatgtcaaaacacttggaagaccaaaagtgggtggagaagtggtaaatcacttagcagatcagggtttgttaaaccacggtgcctccagagggggataaaaatgagaataaaggcattttaccgcccccgctgcccaacaagccccagaggccctgcaagtgttgacatgatacaaatagcaagaaatggaagcagaaagaggaaagaacatgtgagcagagtatgttcacttactgctgcttctataataacaagaagttaaagagtattatttaaagttgacaaataaagaaatggacaaaataattacacttgacagtacaaaggtaagcacaaaaagatattattaaatacagtcagataatggataaaacagagaggaaaggaatcaccaaatggaaatgagagattttgattaaagaaatagtacactaaggacaatgtattacacggttttaattataattataaatttataataagtttttacttataaagacaaccactaggataaagatacaaactctttagtaatctatatatttgtaacaaataatatgacaaactctaaatactggaagaattgtacatcaaaaaataaaaagcaaataagagatgccaaataatgaaaaggtacaaaagtaattggggtttcagaccataaatattaaatcattataactaggctcaaacacatctttattaatcaaagtaggaaccattacaatcaacacatttttgccaatgagaaatgagtttgtttattcctgtagcataaaaatccatgctttgggattcaatgaactcttggaaggcattttctgcatcccgctggttatggaagtgtttcacctgcaaaaagttgttcagatgcttgaagaagtggtagttggttggtgagaggtcaggtgaatatggtggatgaggcaaaacttcatagcccaattcattcaacttttgaagtaactgttggttgtgtgacatgcagtcggttgttgtggagaagaattgggccctttctgttgaccaatgccagctgcaggccttgcagttttctgtgcatctcatcgatttgctgaacatatttctcagatgtaatggctttgctgggattcagaaagctgtagtagatcagaccggcagcagaccaccaagcagtgaccacgactttttttggtgcaagttgggttttgggaagtgctttggagcttcttctcagtccagccaccaagctggtcattgccagttgtcaagtaaaattcactttttatcgcacatcacaatctgattaagaaatagttcatttttgttgcatagaataagagacgacaacacttcaaaatgacgattttttaaacatttttccttagcttatgaggcacccatttatggagctgtttcacctttccaatttgcttcaactgccgaatgaccgtagaatggtcaacgatgagttcttcctcagcttcttgtgcagttgtaagaggatcaacttcgatgattgctctcaattggtcattgtcaacttccaatggccagccactactctcctcatcttcaaggttctcatctcctttgcaaaacttcttgaaccaccactgcactgtacctttgttagcaatccctgggccaaatgcgttgttgatgttgagttgtctctgctgctttacaacccattttgaactcaaataagaaaatcgctcgaatttgctttttgtataacataatttccatagtctaaaataaatataaaataaacagcaagtaataagtcattagcaaaaaaaaaagtgagaaatgcacattaaaatgatgtataacatggtcacatttatttaagaatgtattccaatatcaaacggcaaatttcaacaatgcaaaaaccacaattacttttgtaccaacctaatattttaaaaactaaatacgtcatatgaaataatataaacaagctaagactaagcaaatctgtcatgtcactaaatataaatggattttactcacctatttttaaaaatgcctattacattacaaagcaatacccaactctatgttgaataaaaaaaatactcctcacggtgatacagaaaggctaaaattatagaattcaaaagacataagcaaaggcaaacaaagaaagcaggatccatgattttaatatcagagaaagtggaatctcggtcaaaaagcatgaaataggacaaaaattgcacagacatattaatattaaagacgatagtaatctatatctttgcaacaaataagatggcaacaatatttataaatcagaaattattagagtaggaggataaataaaaacattgtaggaatagaaattttcaattaattttagccaataacagatcaaatgtattaaaaagtatgtaaaattatagatgacctagtaatataattaatataatgtatctgattaatatatagcaaactaccttccctaacaatagaaaatgcacctccttttcaaaaaaccaaacatatcaaaccaaatattaagccatgacaaaaacctcaataagctccagaaagtggaaataatatagaaaacattctctgatcataatgaaatagagttaaaaaaaataaccaaatttaatgaaatgagaggactttccacttgataatttttaaaaatctctcttaaagaattcttggacaaaagacaaactataaactaaaattatataatttcgagggaaggaaagataaaaaacagtttaatcagaacctagagagtgcagttaaagacatacatattcagggaataagtcacagcatggaagcatagaatatttatatcagtaaaagctgaaaagaaattatttaaagacctaacaaaactagaaaaaggataacaaatgaaagaaagaagttaataattataaaaagcaataaattacaaaatagaaaaacagtagatctaataaatccaaatgctgttgtaaaaatatgcacaagacctttatactaaaaaataatacagcattattgagagaaattttaaagtacctaaatgaattaaaggatgtctcatgtgactggattagaagattcataattgttagaatgtcagtgctgcccaaattagtctataaattcaatgacatccccaaaaaaatcccagcagcagctgttttatagaaattagctgaacagatttcatttgcatggatgaagtgaagtttatttaactattttcctattgatagacattcacatttatcataattaacataatcctcatattttgccaccacatattaattttttggtgagtatccttacacatgtatctttgtacacataatatgagtaaaattaaggatgaatttctagaagtagaattgccaggtcaaaggggtgtacattttaatttttgagatattgccaaatcgtcttccaaagttggatcctttccattcccagtaattatcaaatccattctttaggagattttgtattaactgaactgttgacataattccctttatatgcacactatgaaaagtataacatatacaaatctacctatatggtcacaatcctgggaatttatgtgacaggtattggatgatgttcagcatccttggcctcgtggaaataatcagactagattttctttttgaaatgcaaattgataatagccattagttgtttcctatgttgctgagaacccagaggaagataataaatgtccttgggatagactggggctccaaagatcatgctgtatacttttgaaaaagcattaaattgtagccagtgaggaatcagaaaccaatcttattgccatgttcttaacacaatctttttccttatcttccctcccttccattattccttgctgaaacattagctttgcacaattacctgctgataatggtagctctatgtctttctgcgtgcctgcctatctgtctgcttgtggaaagataaagatagatattccattttctaatcccctcttttgcttgggaagaaactagaggttcttcctcagattgggcaccagaaggtaaagagagcagggggtcaaaaattgttaagaagggcaagactagaactttcctactctccccatgccctggtttcagagaatcattgaaggggctctttgatgaccctaggacactcacctctaagcataacaatattctggaaaacctttgacaaattatagcaatttggttgtagagaagataaatgttttctcacctggcaaagaacatgtgaaatgaagctgaatctactgcaaacggggaagtgggtgtttaacactgcatgcataaagtattgatttgtatcttttcaaatttatggaactgttatcattttatatgtgtgctttatctgatgttttaaaattatgtttttgggatttgcccaaatggatacatgtagacctaattcattcattttttattgccatatagtattccataaagatattatcctgtgttttctcctcaaagttacagttttcctttctacatttaggtatttcaatctcctagaatttatttttgtatgtgtgtggtatgagataggcttccaatatttttccatatggattattccaacatttttttcaatacatcatttcccaagtggttcctaccactgcttctgccatgcaccagattcccatgtctactgaatctgtttctcccagtaatctcattgtcacatcctgagtcaacaccacgtggatttaaatgctctatagtaagatttgacctggtcgattcacatgcccctccttatttgtcttcttgaaaattattttggttcttgtttctttacttttccatatcagtttaagggtcacattttccagctcttttcttacaactctgtggaaactttgtttggtaatgcactgaattgatttatcaccacaggaagaatcgccacatttacaatacgaagccttcccacacatcagtatggcagatctcttaatttatacaggtcttctttaatatttttctacattttataatgtctttttcctaggtacattgcaattttggttgccctattgaatacttattattgctaaactgtcttaatattattaatttctatatagtgattttgcatccagcaaccctgctgagctccttaaagttaaatttttctgtagattcccttggacttcctatttagacagttatattatctgcaaataatgacaaacttgtttcttcctttatgattcttataccacttttttatttttcctgtcttattgaattggccgggaccttcaacaagatggtaattcaaagctatgacagtgagcatatttattttgctcttgattttaaagtgtgtgcttctaatgtttcactattatgatgtttatgagagtctcataattactttttatatcaattttttccatttcttgtttgttgagactttcatcatgaatgggtgttggcttctatcagtatttttatatttattgaggttatcatatagtctttcatctgttagtatagtaaatctgtaaactaacaggtttgttagtctatttttaatggttccagctgatcattttgctggattcaattaggtgtatttcattttatctattttgctaaatgaggctggcctgtaatcttctttcataaactgtccctttgggatgttccaactctctcctcaattgtccctgggaactccaacttattcttactttgtttagcagagcaattcatctctctccatctcctacaatgtttctcaacaagtgatctaaggatctctatgcacatataattttaaaatctaacatgtaagattaattattatattcatagaatttctaactttttatgttttcaaaaacagtgtatgtgcttcaaaaactgatttcattcataatggttaacatggagttaatcataggcagtttatcttgactaatgtattttattgtcacctgacagttatttacacttgtcagacttgcatttgccattattactgtcgctttgcataatatcacaattcaaaaaaaagagtcatcacttcgaaagtggttttctgaagcataacaataatgataaaaatagaaatataaatcctacaatgtgaaataaggtcacaatgtaagtaatgaatggcctccattgtaaaaatacaaagcatgaatctgtttgtcatgagacaagtggataatggatgtggataatctcccaaaaccagacaaaaatatataagaaaatgggagccatgacaatgaataatgataattgaattttattggaccaatgatccttttgtcctagtacccaatttattatctgctaacgtttttgtcaagtaatgatataaagctatcaaaacttccatattattttccaataaagtttatcaaccccacttttaaaccaattgaatatctctactacaagcacaaaataaggctttcccagtataaaattgtgaaaattttatgttaaaggttgagaagacaacaaaactatagagtcatcattcatcctcatatcaaaaataagcacaattgcactcctgctggtaagatacaaaaccagtttccaaatcaattacaaatattgtggttggagaagaaacaagaaaaacaattggtataattccttaattagaagtattgcattccttataatgtgactggcatttaaagtcaatgactgttaggtatacgagcagacattttattttatagttgaacaaaactatgaataagtaagttgtcagcatatcttcactatatatatgggaaagactcagtgactttttgttctatttatcatgaagctaattttaaaagaagagctctctggtttaattaaaaattagtttgaacctatgaaacagactttaaaaggtatgttggcttatgcactaatgtttgtagcagcgttattcacaatagccaaatatgtccatcaacagatgaatggataaaaaatgtagtatatatgtaaacaattgaatatcattcagttttaaaaatgaatgagattctgatacatgccacaacattgacaaagcattgtgctaagtaaaataactcaaacgcaaaagaacaaatgttgcatgattccacctttagtaggtacctagaacaggcaaattcatggagacagaaagtagaatggaagttgccagagagggggaatggggagttattatttaatgggtacatttctgttcgggattataaaaaagtttggaaacagatagtggtgatagttccacaatactgaatgtacttaatgccactaaattgtgtacttaaaaatggtgaaagtggtaaattttatgttatgtatattatgcatattttaccaaaacttttttttaaaagaggaaaggtgttaaattgccattgaagaaactccagccacatggtcagcaaggaaaggtatcactatccagatagaagatgctgctcccagatcccaatgctagtgcataccttattcacggaacgcagctgggggtctgtaatatgcctccagattctgatttgctgttgaggtacacagtggaaattgtgaatacaaactgattgtggtcacttagtgtacatctctttggcctactgggctgaaatgaaaagtgagtaagagaggctgctctcccacactgaattgctttggctggcaaatgggaagggcttacacagagttttaaaaataaggaatgaaatgttttaaattaccatttttatgaatacaagttgggtatctcagtgatccattcagaatttgaatattatgaatctttgttttcagagcctgaatatcgggatttgtaacaatcagacatcagtggtgcaagtggctcaacggctgagaacttgactttttcccaatacccaatgattttcttcattcaccagaaaaagcacttaggaaataacacattgggcttattaaaaattacatctgaatgctgcaacccaacatcaagaaataccttgcagagccaaataccaccaaagagaggatgcaactccattagctgctgttgagctggggcacttgccttctggtgaagcactgaaaatagtctttagagagcactctctccataatttctgggtctgtgtttgatttgacaaaccagaaatatccatcaaagcttcccaacaacctataattctgagttaagattttctaatttagaaaacataaagagtgtgggggggaaaccaacaagatatggaagctgacagctcaagcagctatgcaaccagatatagattcctaaatgatttcaaacacgatttctcctctcacagatgtgaaaaaaaattattcactttttaacttgacttttacttttatttaagacatatatgttcataatttaaaaggtcacagagttttataaagattctgacaaaaaaaacagcaatttcatttttctcatctcttctttccagaggccaccacttttagctttttttacctgtgtcttctgatacctccctatctccaataatatactcataatactaatttttaatttttcaatttctgatgttatttattggcttcctattatgagaaaaaacttaaggccacatccacaaactcatttcctctcaccctcatcttcctgttacagttatattgtaatcttcagttagatcatcagataatatatccattgtatgactacatatataattacattacattgctaagtaaacactgtttacagctgtgtcatgcagtgtactttgactatatttcctttttgcacaatgtttttgctttccttggagttaataaggattttatttttttgtttgctcagttttctatttatccctaatttgttcccaaactcttctccagatgtttaattgttgcttcaatttatttgcacacatcaggtgcatgtgtatcatttttttcctatgggaatcacagctagagtacttcatcttctgcctcattctgacctagatgttttctaggcctgatgcacagctgttttctagagattttttcttcttcattctttttttggattccttttgcctcttccctggatcgcatatatgtttcttgtttgaatggagcatatcctctagtaacatttttttttaagacaaagtctctctatgctgcccaggctgttggcctcaaactcctgggttcaagtgatcctcctgcctcaacctcccaagtagttaggactacaggtacataccaccatgcccagcttctagtaactttattagaagggtaactaagaagtacatttcccaagacttcatatattctaccttctttgacagtttggctagggaaagacttctgtattagaaattatttccctcttaattttgaaggccttgctcattgtcttctaatttctttctagacctcctattagtcaaacaatatacctcctagtctgattctctaattttcaaactttttatcacttcctatccatttctgcttttttgttccacttcctgtgagatttccaaaactttatttacaagtccgcctattagtgttttacttttgctatcatatttttgttttcaaaattccattttgtctttgaaggtactttttacatccttctgctcttgttctatacgtggagcctcttctcacctcttaactctctaaaaatattagtacaggtttttttttttttgtttttgtttttgttgttgttgttgttgctgttgttgttgttgttttggagacgaagtcttgctctgtcacccagactggagtgcagtgacgcgatctaggctcactgcaagctccgcctcccgggttcacgccattctcccgcctcagcctccggagtagctggaactacaggtgcccgccaaggcgcccggctaattttttgtatttttagtagagacggggtttcaccgcgttagccaggatggtctcgatctcctgacctcgtaatctgcccgcctcggcctcccaaagtgctgcgattacaggcgtgagccacagcgcctggccaatacagttttatttctctaactcttcttctgccctctttattgtctctttttcttttcttttcttttcttttttttttttttttcagttgtttggttgctttggtttctggtgttagaagcatccttcaaattcctgatgctccttggctggctgttcatgttaaaagtgcagcatcttcatgggctctaaaccagattatcttctggaaacttaacgaggagcagaagtgaatagggaggggagttgtttgcctttcagtaggtaaacttttctttatatgcatttttcagtatgcaactgtttccctcttcttcaactcttaagaaaatgagcatccaatccatttctggagcagaaacagtttctcattgaatggatggcataaagcagcatctagaaagctcaactggttcctgtaaaaaactttcaagcaattctttcagccctacttatcaccctcccccaaaccttgctttcagagatacttagcatctctaagttccaagcagttctggggctctgcagcatagcttggcttgcttctgggtattccctgcttcagccagttttcagctttcttaggtctgctctgtcagttaccactcatcagtctgcactccagtttctaaaaactgggagtttttagatgagcctccagcttcttgcaggatagggaggccctggcagacataaacaggagaatccttgctcttcacccgctactgccctctgcctaaccccagaacagcagaagctgctggctgtcccagccacacacatccctccccactccatctatttgtgtggcccttctttttccctcagtctgtgtcttgtttcctctccttaccttcttccccctcatcaccttggtgatattctttgcatgttttttcttggagcagtcagagcaggtcatccctccctcctggaagaaggaaccccctgagtacactccatggcacagttgacactccttttctaccctccttcccagatatgtcttcactgtcatttacacctttgaagccttgataaagatactggcaagaggattttgtctaaatgagttcacgtacctgagagatccttggaactggctggattttagcgtcattaccctggcgtgagtatatctctatgcagatctgcatgtgtgataggagaggggacaaaatggtgggtaggagacagggctaacatgcaggtcccacttggacagagtgtggagactcacaccatgaacgtttgctccaagaaccactgcaggaatataccaggagaactgaaagaattcatagatccttttaaataagtggcacactgctggaaattctgcaagacaggtgaaaaactgtgagctcccaaagtgtgagggggggaaacctgcctccaaacatacatcccaactgggtaatctgaaaatccagatcacaggagaagaatttacccttacctggaatgtaaataaatttaggaagccacacaaaatataaaagtagaaacagcaaagggaagtgccttgtaggcactcccagtctccagcttgagaccagggaatccatccctgactatgtctcacaggcacccttggggaaggcagccagtggaatcagggaggggtcacaggatgaaagaagtttcaactaaaattagtaataatttcaactgggcacaaattttcttgagcagaatccagggggcaaatgggaactgcaagcagacagtgagggatgcggtccaaaagtcatgctttctttctcagtggggaagctcacagcctggggcaaggtctgagtagggcactgcaggagcaagaccagcctcaccaactacatgagagctaggtgaggcctctcactagcagctatcccccacttccctggagaactctatggcacagcagaggcagccaaaattccctctggaacacaaccccactggcctgagaaccaacccccatccaccacagtggccacagcaatccctacccaagaagggtctgagtctagactcacctacccctgcccccacctgatggtatttccctacctgccttggtagctgaacacaaaacccagaaactctcggaagctttatggccctgctcatcacctaagaaactaaaatatttaccctggccaacttagggtgagcttagatcccccttctactaatgcactagtgctctcttgaaagcatcacctaccggctggaggtcaaacagctcaggccattaaagcaactcatgacagaataactttgatcccaggaaaaagaaaacaacaaccagttgcactgcctgcaacatcctggctaaccagacgtcctgagtctgtccatatgacaacttcactgctaacataactagcattcaagaaagccagcacactaaatctatctacagcctaggactctcacagactctacttcattcctctgccaccttcaccagaacagatgctgatatccatggctgggagacttcaagatcaatcacatcacaggactcttgcaggcatttcccagtactaccccagagcctggtagcccctctgtgtggctaggcccagaagaacaataacgatcactgcagtccagctctcaggaagccccatccccaggggattggggagagcaccacatcaagagatcacccatgaaacaaaagaatctgcacaacagccattcagttccagatcttttctctgaaatagtctactcaaatgagaaggaaccagaaaagcaattctggtaatatgacaaaagagggttcaataacacccctcaaaagatcaaactagctccccaacaatggatccaaactaagaagaaatctctgaattgccagataaagaattcagggctgggcacagtagctcacgcctgtaatctcagcactttgggaggccaaggtgggcagatcacctgaggtcagaagttcaagaccagcctgaagccaacatggagaaaccccgtctctactaaaaaatacaaaattagctagatgtggtggtgcatgcctgtaatcccagctactcaggagactgaggcaggagaattgcttgaacctgggaggcagaggttgcggtgagctgagatcgcgccattgcactccagcctgggcaacaagagtgaaaatccatctcaaaaaaaaaaaaaaaagaattcagaaggctgattattaagtgattcaaggagacaccagagaaagataaaaaccaacttaaagaaatttttaaaacaacaagatatggatggaaaattctccagagaaatagatataaagaaaaaacaatcacaacttctggaaatggaagactcacttagagaaatacaaaatgcagtggaaagtttcaacaatagactagaacaagtagaagaaagaacttcagagctcgaagacaaagcttttaatagacccaaactaagacacacaaaaagaaagaatttttaaaaaaatgacaaatcggccaataaatttggaatcatgtgaaacaaccaaacctaagaataatgggtgttcccaaggaagaatagaaatctaaaagtttggaaaacttatttgagggaataattgaggaaaacttccctggccttgttagaaatatagatatccaaatacaagaagctcaaagaatacctctgaaatgtgtcacaaaaaagatcatcacctaggcaaatagacatcaggttatctaaagtcaagacaaagaaaagaatcttaagagctgtgagacaaaagcctcagataacctataaaggaaaggttatctgatttacataagattaacagcagatttctcaactgaaaccttgcaagccagaagggattagggtcccatctttagcctcctgaaacaaaataattgccagccaagaatattgtatgaagagaaactaagcttcataagtgaagacaagataaagtttttttcagacaaacaaatggtgagagaattttccactaccaagccagcactacaagaaatgctaaaaggaattctaaatcttgaaataaaaccttaaaatacaccaaaatagaacctccttaaagcataaatatcaaaggacctataaaacaataacacaataaaaaaaggaattaaggcaataactagcataatgaatagaagagtacctcacatctcaatactgatgttgagtgtaaatgccctaaatgatccacttaaaatatacagaagggcagaaaggaaaaaaaaaatccaccaaccaagtatctactgtcttcaagagactcacctaacacataaggagccacataaacttaaggtaaagagatgggaaaagatattccatgcaaatggaaaccaaaagcaagcaggagtagctattcttatatcagagaaaacagaccttaaagcaacaacagttaaaaaaagacaaagagggacatatataatgataaaataattggtctaatggaaaaatatcataatcctaaatacatatgcacctaacactggagctcccaaatttataaaacaattactactagacctaagaaatgaaatagacagcaatataataatagtgggggatcaatattccactgacagcactagacaggtcatcaagacagaaagtcaacaaagaaacaatgaacttaaactgtaacctagaacaaatggacttaacagatatttaaaaaacattctaccaaacaactgcagaatatacattcttttcatcagcacatggaatattctctaagatagaccacgtgatagataacataacaaatctcaataaatttaagaaaatagaaattatgtcaggtatcctctcagagcacagtcgaataaacctcggagttaactccaaaagaaaccctcaaaactatacaaatacatgaaaactaaacaatctgctcttgaatgatctttgggtcaacaatgaaatcaagatggaagtttaaaaattttttgaactgaatgataatagtcacacaacttatcaaaacctctgggatacagctaaagcagtgctaagaggaaagctcatagcattaaatacctacatcaaaaagtatgaaagaggacaaatagataatctaaggtcacacctcaaggaattagagaaacaagaacaaaacagacccaaaccaagcagaagaaaaggaataacaaagatcagggcagtactaaatgaaattcaaataaaaataataataatacaaaagataagtgaaacaaaaagcgggttctttaaaaagatatagaaaattgattgaccattggcaagattaaccaagaaaagaagagagaagatccaaataagctcaattagaaataaaatgggagatattacaactgataccacagaaatacaaaaaaaaaatcattcaaggctactatgaacacctttatttgcacaaactagaaaatttagaggagatgaataaattcctggaaatatacaactgtcttagattaaatcagaaagtaatagaaactctaaacagaccaataacaagtagcgagattgaaacagtaattcaaaaattgccaaggaaaaaaagtccaggagcagactggattcacagctgaattctatcagacattcaaagaagaattggtaccaattttattgaaactattccaaaagatgcagaaagagggaatcctcctaaatcattttatgaagccagtatcaccctaataccaaaaccagaaaaggacttttaaaaaagaactacagacaatatccctgatgaacatagatgcaaaaatcctcaacaaaatgctagctaattgaatccaacacatatccaaaagataacacaccatgatcaagggggtttcataccagggaggtagggatgatttaacatacacaagtcaataaatgctgcacgtcacataaacagaattaaaaacaaaaatcatatgatcatctcaataggtgcaggaaaagcatttgacaaaatccagcatcccattatgattaaaaccctcaaccaaattggcatagaagggacatactccaaggtaataaaagccatctatgacaaatccacagccaacattataccaaacagggaaaagttgaaagcattccccctgagaactgaaacaagacaaggatgcccactttcaccatttctatccaacatagtactggaagtcctagccagagcaatcagacaagagaaataaataaagggaatccaaatcagtaaaggggaagtcaaactgttgctgttcaccaatgatatgatcgtatgcctaggaaaccctaaagactcatccaaaaagctcctagatctaataaatgaattcagtaaagtttcaggatacaaaaacaatgtatacaaatcagcagcactactgtacaccaccagaaaccaagctgaggaacaaatcaagaactcaatcccttttacaacagctgcaaaaaaaaaacaaaaataaaaacaaaaaaatcttaggaatatacctaaccaaaaaggtgaaagatttctacaaggaaaactacaaaacactgctaaaataaatcacagatgacacaaacaaatgggaacacatcccatgctcatggatggataaaatcaatattgtgaaaatgaccttactgccaaaagcaatatacagattcaatacaatttccattgaagtaccacatcattcttcacagaaatagaaataacaaccctaaaattcatagggaaccaaaaaggaatccacatagccaaagcaagactaagcaagaataacaaatctggaggcatcaccttagctgatttcaaactatactacaaggctatagtatagcctgtaccaaaacagcatgatactggtataaaaataagcacatagaccaatggaaaagaatagagaactcagaaataaagccaaatacttacaagcaactgatctttgaaaaagcaaacaaaaacgtaagtggggaaaggacaccctattcaacaaatggtgctgggataattagcaagccacatgtggaagaaagaaactgaatcttcatctctcaccttatacaaaaatcaattcaagatggataaaaggcttaaatctaagacctgaaattataaaaaattctagaagataacattggaaaaactcttctagacattggcttaggcaaaacgttcctgaccaaggacccaaagcaaatccaacaaaaacaaaaataaatagatgggatctaattaaactaaaaagctgttgcacagcaagagaaataatcatccaagtaaacagacaacccataggatgagagaaaaatctttgttatctatgcttccagcaaaagactaatatccagcatctataagaaacacaaataaatcagcaagaaaacaaacaaataatcccatccaaaagtgggcaaaggacaagaatacgcaattctcaaaagaagatatataaatggccaatgaacaggaaaaaaaaatgctcaacatcattaattatcagggaaatgcaaattaaaaccacaatgagataccaccttactcctgcaagaatggccataaccaaaaaataatagatgttggcatggatgtaatgaaaaggaaacaattttacactgctggtgggaatgtaaactagtacaaccactaaggaaaacgttatggagattccttaaagaactaaaagtagaactaccatttggtccagcaatcccactactgggtatctacccagaggaaaataagccattattaaaaagacacttgcatatgcatgcttatagcagcacagtttacaactgcaaaaatatggaaccagcctaaatgcccatcaaccaacaagtgcataaagaaaatatggtgtatgcataccatggaatactactcagttgtaaaaaggaatgaaataatggcattggcagcaagctggatggagttggagactattattctaaatgaagtaactcaggaatagaaagtcaagcatcatgtgttcttaattacaagcaggagctaagctgtgaggatgcaaaggcataacaatgacataatggactttggggacttgggaggaaaggtgagacgaaggtaagggataagagactacacactgggtacagtgtacactgctcgggtgatggtgcaccaaaatctcagaaatcagcgttaaagaatttttctgtgcaacccaacaccacctgtttcccaaaactattgaaatacaaataaagaacttattcatgtaaccaaaaaccacctgttccctcaaaactattgaaataaaataaaataaaaagatttgcatgggtgtccatgtggggcttatgggtgtatccaggctcacactctgaagaaggttcttcatctcagttcagcttcctcatttggaattgtatggcctggggttcttgccacagagtaccgcttcgggggttgctttccaagattagtcccatgcccatgaggagatgtcagagacctcaaatctgagataacagttagcctgtcacagtggatcagaaaaggcccagccttgtacccccctgacatggcggtctccttctgagaaatcagtgtctgaggagactggttggtcaaactcctgtgtttgaagatccgtccacatgcagtgttgcctagatcacaatgcatcttctcaaagggtccactctgaaagatgttgcaataatgaaatcagtgtcagtgtcagtctatagatggcagtgtcactagattctaagtgtccattctgcatcctttctaggctaatgataccccaggttatccttatttatgctgcatgcatccccaggacccttgcttgcagagatgctgactaacttctggtcctacagatatgttggcacagcaatagatctccgtgggatctcaggcctgcggacattcagagttcttagagcattaaaaacagtttctgtgatcccaggtgagcatttattcacagagcatatgttggttttcacagcctaactcccttctctaattttcacaagaaccctgtaaggttccagggcaaagactattgtccccacttacaagacaaaggaactgaggcctggagtataggaaacataaacccaaggcctcttcactagtaagagacagtgtgacctggaagcctattgtcccaactcctaggccagtgctcttcccacataccacatggcctcacaatcaatacgtaacaggaggggcatgtcttcactttctgttctggttgtgggattcaggcaagacccctcagttgaatttttatttataccttaaactaaaggattaaacttggaaatggggaggaagggagaaagcagtcccagtatcttcactgtttccgtaggtctaaaatcctgtctttagacacccagaggaaaaaagaattaggcaattcttgattactgagaattcagaaacaaaagtagtccatcaaagctcattgtgtggggcctctaagatctccactgtcaccagtagcccagcgactactcttcagcccccatgaggttgatggtgaggatggggaggccagagacaaggcaaactttctgaaatgggacttgatgcttcccctctgtggcctgataggttctctcctctcaccccaagaattcgttctcttatctgtaaacagaaacacccattctagagtggaagtcttttctaccatttcttgtctggctctgcagggaaagataggaaactctctgccaattcccactggacacacctcttgaagagagccctggtcctgccccttcatatctctctcacttactctcaactgggaagaccctgagtcttatttgcaagacctggtctgtccatactgtctcttctgcctcatctctcacctctcctcacatctcaccatgctctggaatccacctacggttctgcaaatactccacaccattgctcacctcccagccttctactgtgctgccccttcttctgggatatccttcctcctctctttactcaactcacactcattcctcagggctctgccaaggttttacctcctccctggttttcccaccttcctcacactccacccaccccattcccacctctggaacttcagttaagggctgctcccctgtgtgcccatctgctcagtaatgctacagactttcccctcaattgtcagacaacggcactcgacatgctgctgccttagccatcactcagctcccagtccagggactgacacatgtagtgctcagtggattatttgctgaccaaaatgactaaccaaaaataaatcctagattgcttccctggtcagagctctttctgctacctgcgaagctgctctcccaaagaagttgattttacttaccagagcaacaaatcatccctccttaaacaagcaggtgtatccttctttgctgccagctgtgcttggcacaagttctatttatgccccagtgactgtctcagtgtttcttatagtctctttctattgctaaactcacctctctgtttctctgtgtctctttctttttctttctcttggtctatttttgtttcactctatctctcttgcatctctctctctctctctttctctctctctctctctctctctctctcacacacacacacacacacacactcacacacagtgaggttcatgtgtcccaagtctcaagctgcctcccagatgcatgcagaaagacagatgccaaattactggggtgaagttagtagcttcatgcctagcacagtgcctggaaaaagtaggtactcagcataaattatttaaattgaattgctagtgtcaggaattttattagcctcaagatgataaaaaatgcattgcctgggtctcagttgcatcgtctttataatgagaatagcccctgactctctgcctgcctctcagagtaaatgcaagcttcggatgagaaaggtcttggaactgccctggagtgtgtacatacttcactcctgtatgtagagatgaaggaggatggctaagatgaagaagtgtgctccgtgtgtgctacctcatccatgtggtcataccactgtcatcttcccgcaggcctgaaggtcattgtgggggccctgattcactcagtgaagaaactggctgatgtgaccatcctcaccatcttctgcctaagtgtttttgccttggtggggctgcaactcttcaagggcaacctcaaaaataaatgtgtcaagaatgacatggctgtcaatgagacaaccaactactcatctcacagaaaacgtgagtggagtctcttccatagggaccaaggtctggttggacccttggtatcatatagggacaggggatatggagcccctgtgtgtgtgtatagacatatattttgactcccctttcctgccaaaatggttctcttgagttgtgttttacttttgggtattctatttcctgttgctcagcatccctcttgcaaggaaatgagccataaatctagaggcaagtcattctacctctgctgggggagattgagagccgaagtcactgcttagctcttctcttttcagatgtgactttacaacttccatgtggcccagcatgcccactgagtacatgtagccaaaggagctcactttggaagacttgggaatattgcattcaccacacaaggcttgggttggagggttcagaaccatctgtgaggctttcttttcttcctttcttcagcagatatctacataaataagcgaggcacttctgaccccttactgtgtggcaatggatctgactcagggtgagttcccaacttatgacaaagcacgagtgcccaacaattccttctccatcttgtccttggcatattatgggcacagatggggttgcaggtcctgggaaagatgtataaataaataaatcatggcctttgccaacccagagctcatggggagggaatgtatgagttagctttcgctgtgtaacaaatgaccccaaaattttgtgaattaaaacaacaatgtatttaattcatgattctgtgcatcagcattttggactgggatcagatgggcattgggtgacattgactaggctcattcatgcatatgcagacagcatattaacttggagatggctggtctaggacgtcctgtctctgctcatgtggcctctcacccccaaacaggttagcctgggcctgttctcatggcagtgttcccagaaaaacagtggaagtttgcaaggcttcttcaggcctaggcttagaaccaacacaatgtaccttttgtacattctgatacattcttgactaaagcaagttgcagtccagtagagatccaagagacagagaaatagacttcatcactcaatggaaagagctgaaaagtcacattggaaagggtgtggatacatagagacaagaattatagccattttaataaataatctaccccaggaaggaaccaatacttatttgtgtcaaatgctctacacttaatcatcacagctaactccattctatagccacattaccctcacaagtagaggaaaaaacacatgtatcagactttgcaatttcgaattcttacagaggccagattcataacaacaaatgagtggagtgggccaggagggaacctaggagctgagagttcatgcctcctctaaaggggacagccccactgctcggtccagcttttggttgccatgtggaaatgtgggttcactgtttccagctcttccaacttttaaaatagagataggaaatttagatttttatataaaatctcccaaccgtaaacattggctacctattccaaaaaatgtctacatattgttgggccaaacaaaatatttctgtgggccaaatccagcctataagctgctagtttgcaatttctcattcatagacataaagatgctaccctgtggaaaacaagttctttactagaggcttcataggctgggcaaacacagtgaggtggcggtgtgaggcaagagagaaagtagggaaggcttcctggaggtggtgtttgaggtgagctttcaagggcaggtaggatgtctccaggctgggtgaatacgagatagtttcagcgaagaccattccaggtggcagaacagaatgtgagacaaagctaagggatgaggacccctcagctctgcctgctgctttggccactggaggaaggcatgagcagaaagactttaggcaaaagatcaaaaaggcccatctcacccacctccatggctgagagcttggaaaagcagagctcacaacacccccagtgcctgagaggctgacggctccatgttgcccaggtcgacctgtgtggagcctgcatgaggctccaccttcatcagctcactaggaaaactatctcagttggagctgaggactggaaacaagcaggagcatttggtcaacatcaggttccttggactgttctttcacaaatgcacttggcatttggttctttggctcatgagagggttgttctgacatcagttttcatttgcctttgacttaaatgtaaaccaagagcccctcagcatccttctgtctagataatggcatttctcaaggcaatggctccagagcagctcaagtcctttttgtggtaaagttgttgggtccatctacacacctctacagctcagctccctgagaggccaggcctgctattgggcaggtgccagccaggcagtgggggagtggaccaggctgggatggcagagagaggccagctcaggataacggacagagtgaaccctgccggggcatgccgtgaaagctaaacctgggtcctctgtggggctgcagagaagccagagtcctgaggaaaggcccacattggccaatggcactgtgggaggaaggtcaggggtctcaaggcagaaaatggataccagaaaatagttgataattttcagtgttcttccacatatattattccagtttatcctttcagcagcttccaaggttaaaaacaataggaattttcctttgcagtttatatacaatatttactatgcagaagtgcaagacactatacagtgatctcatttaatcctcagagcagtgaactgtttatatgcagtggctatggtggatttctacagaagacatagaaacaaggctgccctcagagttaattaagaaacctacaggaaatgggttgcctagccccttggaagagcaaaccaagagcctatctttaaatgtgggtctacaaagccagggaacttgcaatcttcaatcgaagtggagatagacttggaactgattagaattaagttgtcagagctctaatccatggtatgggttgttcacatggatgtctgggataaggagagccccagaggttggagttcatggagaaatcctgggagtaaaagaattccatgtattcacaaggaatgcaggtaaataaaacaggagaaaaagaaaaaaatttaaaaaaataattctggacttcaaacgaggcattgctgtttcattgatcaggccatctctgctagggtggatgagagcactttacgctccctgagctgacagatgcttcttgacatcgactcatcctcctattatgagagagaggaaggagttcagcattcccacctcaatactcaccaggcagtcatttttaatctggccttccttcataggccatcttcaggaggaggctaggctgactcaagtattgggctacttgacagttatatttctccttttaataaatatattgacacctgcgtagttttaggcaactgacttctttctgacccccagattccttatctgtaaagaaagaacattgagtgattaaattatagtgtttgtaaagcacttaaagggagagagaagaacacagaaagtgctcagtaagtggaaagtgttatttccactgttacatataattaatcagtgaacttggctaatgtgagacctcccttgatagacaactctgcagatgatgccaacaggctcaggttttaagtctgcgttattgctactgactctcatttccctggtatgaactggcaaagagcttatagtatcgtgtctgggcagtcagctgccttccccaggccactcccctgtgtatgaaattctgacgtgaaagtattagcgtccccgttttatggataacagaaaccaatacctaaacagaccaagtgtccaagatcatcctgctaataagaggaagactaggtcttgaactctgatctctgacataaaactctgtggttgtctcgcagccctgggctaccttgtctgcaataagcaggggatgaccttctctgttcttgctgcagccactgccctgatggttatatctgccttaaaacttctgacaacccggattttaactacaccagctttgattcctttgcttgggctttcctctcactgttccgcctcatgacacaggattcctgggaacgcctctaccagcaggtactgagctgcattcccccacgcagacttggttggaggctggtgggtcagctgcatggctgtgcttttcctggaggaggctgacttaaattcaggggtccatgtgctatgggtacaggtttctcttctttcccttgaacctgcagaccctgaggacttctgggaaaatctatatgatcttttttgtgctcgtaatcttcctgggatctttctacctggtcaacttgatcttggctgtagtcaccatggcgtatgaggagcagaaccaggcaaccactgatgaaattgaagcaaaggagaagaagttccaggaggccctcgagatgctccggaaggagcaggaggtttgtgaggagtggaagctttgtgaagaaggttgcagactgtccattcttggatactgttctggactagccacttcaattagggcaccgtttagggagctataggaggaatcatcttgcctcagggaccatattagatcaggttttctcaaagaagaagctaagtgaggattcttgtgcaagtgacctattgagggagtgctctcaggagaaagcgaatgaagcaaaacagaatggggcagagggtggaactaaacaaggagtgttctcagctagagaccagcttcagcttgatcccatggggaactctggggcatgacctgtaccacagttagtcctaccttgaggcaagggggccagctttttttttttaccctccccatacctatcccagaagcaggcagccaaaagagactttttttgtagaatgctgcaagtatgagccatcagctgctgccatgcaagcagctcgggatagctgtgctgacctggtgaaagggatctgggtggggcaccaacagagtaccccatgaatgagtgggggtgacccgaggtgtctgttcctgccatggcctaatcccaccaccaccctggtcctaacccttcagcttctctgtttcagatctctcacccctggcaccccatgtctgggggacacattcatgctaagtccaagcaaatactattggctacacctgctgttctctcttcgcaggtgctagcagcactagggattgacacaacctctctccactcccacaatggatcacctttaacctccaaaaatgccagtgagagaaggcatagaataaagccaagagtgtcagagggctccacagaagacaacaaatcaccccgctctgatccttacaaccagcgcaggatggtaagaggctcaggtttgtgctctaaagattacccaccattgcagctgccgtagacaatgagttggagtgggaagaggtgtgtggcagagaaagagctggaggcatagagcctaaaaggatccagacacccctccaaaatggtgtcttaaactaggaaagtgtaattatagatggggaaaaggggtgaattataaggacaccttagggaagtggatcaacaagattgggattgtggactgtggaaaaaggaaaggggagtccaatttgactcccaggtttcaggattgggcaatcaaatgggtggtgattccaagatgaggacactggaggaagaaccccggtttgtaggaaaggtgggaagcccatactgaacatgccaatcttaaggtgtctgcggacatcaaaggtcagcttccttctgaggctctggtctgcagttctagagtgcaaggttccctgtccgtggtgctgagatccttcatgcaccttttttttttctgatgcgtcgaggtggtttttatttttttacttagttttttttaattgacacttcacaattttatataattattgggtataatttctgacctccttcctaaggtcctgcaattcaagctgtcacctgttgttatcagaaaagtttccagcacccatctctgtgacacaatccagcctgggaatggcttcagcacctcacctcagaccctgtagcaattcttttccccccataataactttctgcctcccactctaaaatttgcactgcaactttcctcgccacgcttcctcccaccaccttcctgccccttgaaagtccttttaccccaaatatgccctttctataggtctgacagataatatctgctgtgtgggagggtggctccacactaacagtgtggaaaaggggatcaacatggctatttttttatgctttatacctctcacttccctctcaatctcttttcctgtgctaagccgaaggatattttacttttttgcaataccatctctccaaccctcagatttatgtgtgcatatacaaacacagacacacttgcatgcacactgacctcatgacacatccacacttcagcatttatctgcatctgtgccctcctctttcttgctttgccccttttgagcagcacctggcatacatggggcacagttcagacaatcacagaacaggatgaatcacagcttccatggaaatgtcaatgacactgaattgggctttaatttcccccattctgtcagccccacacagattagcacttggatgtccaataattggtatgtgtgcttgtctctccagtgatgcttactttcaaagggaaaaaagaggagctgtaacttgttcattcaacaatactaggtgcttggtataaagagatgactagaacatgttcttttccctaaggatttccatttgggtggaggaggcagatataaacacagctatgtgttaaatagtgtattagagacacatacatggtgttttgagaatcagggaagaaacatccactcttatggggctggataggtatcagaaaaggcttcctggaggaaggcataattgggatcaacaataaatagcatgtaggggttcttctagtaattgaagacttgagagagtttggggaggagtattttcctggcagaaagaacaacatgtatgtgcaaagacagggaggcaccatttaagtacttctttaatgctaattgatttattggagcccactcaggaaggcatcctctccctcttttcccaggtacattcatgtggtaaatagacctaatgcagtttttatctaaagccattttataaccaatagaaattaaatagaggaatatatagaagagacccaggagggtttttgtggaaaatcacagaccagttggtctcgttagaggatgaattttaaagcaattctaatgcttatactcagaagacattgcccaccatttgtcaaaaccttaattctaaaataactcgtggccaaggagacactgctgtcaaatatgcaaccaaaattttcttctcagtttcttcattggtttgcttggtgctcaagtgcaaataatgtagtattcccttccttaatatggatgtgtcaatttttctcatttgcttcaaaaattggaaggatttttgcattttatgagttctatagtccttgggcatgtattacaggcagagagtactctatttataatactgagcttttaataatggttgctaaacaggatcaggcttcaaattatcaagagaggaaacttcagttctgtgagataaggggattagtaaggagaaccccaattggcaagattctccactttagtagcttagtaataaaaaggagttaaggaaggtgagtggaataaatcggtatgatcagagtttggtatgaagtcaatgtttagattttgtacatactatagaccacctgaggacacaaatgatggtttattatggtcaagtttcactatggtcatgggaactacctaacccagcacactaattctctgagggctctgggtttatgaattagctcttttctctggcaactttaagccacacagttccctcaatggaagattttgatgggaaatgtttattgatttggaggaatgacattattcttccaggaaattaggctgcaacccttccttcagtctctccattgttgactgttcaagcctcgagggatcctagaaactcattgcactgtacagctcttgtctcctcctttgcaacacaaactctcacattcatacagatgggatctaatgaattgtactacctaattttcagacaatgaagtgcacttattcattcaacaaccacttaccaagtatgttccagtactggtgtgcatagtagcctccttaggtcacaactttgcatgtggaaaagtgaacttaggacagctttgtctagccctgtggccaaaggttggcaatcaactgaactatccaggtgacaaggtttcctctgacatgttcctgaccatgataacctatttgctgagcatcagcacgctgtaatctctcctctctcctggtctttcccggagtctatctagagtctccttttttctttttccccaccatgcatacctagaataccccttagatttgtgcctttacttagtgactgaaaggtcataaagacaggggcagggaaatgggagtaggtagagggaagtgttgggctctagatttcccagaggaccagtttccagccttcttgctcctttggggcaatgcccagtcttttctaggcctcgcctctggaaaacgccgggctagtcatggcagtgtgttccatttccggtcccctggccgagatatctcactccctgagggagtcacagatgatggagtctttcctggagaccacgaaagccatcggggctctctgctgctgggtgggggtgctggccagcaaggccccctccctagaagccctcttcctcaacccagcaaccctgactccaggcatggagaagatgaacaccaaccgccgcccactagtgagcttgcccctggagctgtcgatgtctcggtgagtttgtgaatgcttcagactccctcaggctgtcttccacctagaagccttgagccaagaagcctgagtatcaccaatggaagggatctttagccatcatcctgtccaatgcctccccattctactccttttttacagacatagaagatgagacccagagagagagagagattgagttggcctgaggtcaaacaggtttcctggtttattctgcagtagtgatgcaaattatattccatttgaccccatatttcttatcagtgcttctctgtccccactcaacatcactgcctcagtgataggcctgctttcttgttggacaggtatgagaaaaactgaaggacccttctcttcctgcttatggctctatgcaaactcttctaggctgggcaaatggcacccagagaaattcaggaagtttcttaggacagatctgaatagaagcacagtattccttgctttactcacagaagaaataatttgccaaaatgagcaaattaggcaacagtgactaactggccagcactctttaatagaataatcgcagagtgtaatggcaagtcagggattcctcattggattgggagctgtgagttaatgtgagctctcccctccagtttcagcaatgatgtttctagtgtttttcatttgccctctctggctagccagggatacagcgcaattgcagacagaattgtaaagagaccaataaatggttccactgatacagataagtcttagagttgccttagctcagtctctgactcaatgtcatgtgattcagggtcccagcaagaaacagatggaccactccgatgggctaatagagagagtttagtaaagtatttacagaggtgtgggctgggcttagggaatgaataagggacagtgaggcacctagaaactagtaacagggggaagctgttacatgcctaggctgaagggatgaaggaaaggaccagaattagactacagcagcagctgccctcatgtgtcagagaggctgcctggcagaacttgtgatcttagtagaggatcacagctctgctactcagccatagcacaggagagaagaagccaggggaaaatacctgacttgtctctccttctatccttgaatgtcctgcctatgtctcccattaaccaaacctggccagaaccagagggtaaggataacacattttgtacaggtctccctccccaggaacagagacagtggagaaggtagagagtaggtctccagggcaaatggaatcaccaaaacagagccttaaagtcaaaggcatcctgcagggctcgctgggagtgcattagcactctagaaaatgcctcactgaaggcatttatgcctctcttgtgatgggcccccaccctcctttctctgttcctgagattatcatgtgtctagatattctgaccttgattcattctagttaaattaccaggctagtgaaagattgactctttaggcccttctgtttagtatggacctatattttagtcccaactgtgccagttaccacctgagtcacatttagcaagtcctttaaattatccaagcctccttatctccccttgtaaaaaggtttctaaatagctggagggttaaatgaaataacaaagtgcctacatttttatacatgtctgacagataacaataaatagtgactactagtatcatttgcttagtcctcatggttggaagctttataaactttctttatgtttattaactgtttatacttacagtattcagcaataacatgctgtacagatttgtagcctaggagcaataggccacactatttagcctagatgtatagaaggctatagcatttgtttgtgtaaatacaatgtaggatattcacagaatgatgaaatcacctaatgatgtatttgtcagaacatatctctatctgtaagtgacatatgactatatatgagattggccaataagaggctgaatgatccaactttgccatgaagatgtcaggttaaaggagcgtcctgactctgtttgtgtctcaacaggcattcgatgcaggacaaaagaagactttcttgtcagcagaatacttagatgaacctttccgggcccaaagggcaatgagtgttgtcagtatcataacctccgtccttgagggtaagtgctgctcactgcattgttcatccactgtgtcatgatgaattcccatgtgagcagcagaagcaatgtctctaactcgtgtcaaagcgtccatctctgtgtactggaattcctaatactcctcattcttatgtcttaggccccaccatcttttatcaatgtggttttttagatgcataatttttcaaaaacaaaataatttgatgaataaaatatcctagctcatctcttgttcaaattagcatctgctttgcatgcatcacaaaactagatttttaaaagtgatctggcaggcatcagagaatttcaggccagctctccggtgtacaagaaatttaaccatccttaattttccaacatggcaaaattatccttttcatggtttcataattatatttttcatggttgtaacttacacagttgtaatttaatttcttgttcaagcccacattatgctgaatattggtagacaatttaagtccattaatcagtcaatttaactaagtccttgttaatttagaattctaccaatcaagtgggaatccactcagtctccccagcaatgtatctaagttccaagccaaagggtagaggaagagagtggcaatggtcatggccacctatccacacactttgccatagagcgtgattgcatccctctaaccttgagcaggaggtctgttctaatccagcctttttttgccttagggtatggagaatgcaaccttcatcatttccagttatcttactcccctagacaaattaaactgacctaggctggaggagttgtaagggagcttgagtgctggtgtgcccctgagaaggagtcctgtgtgttttcctcccagccctaggctgaatcctaatttgaggggaagaagtggtgagcaatagaaaccaaaaaaatgtttgagggatttcaaaacagagccaatgtgtgccctactttctaggtaaagccagaggtggcaagccttagagagagattcacatgcacagaaactgtagagtagaactagccagtaatttaccagatatgcagagatgtatctgttttgctcacagctggatctccattacctagaagagcagtgcattaacaaaggtgatatctggggggtgatgctactttatagtggtgtaaactgataaaaaggaagaaaataaggaatagtcaggtatcttggggtaggatagacttccgctcaaggaagatactgtgagagtagagtaagaaaggcaggagaaacaaagacgtttttaagaaaatctggggaaaggcaaccttagcttaggtcaaccttaggttagagaaggcctgaagcagcctcagagagagccctgtggctccagaatggcagagaggagctgggtgatgacttagcccccagtgaaggctatggaaaaagatgagtgagacccatagagggaaactagagagagaagagccatcttcatggactctcccaccagggaccagatgggagctacaactcaggcaaaatacgcttagcaatgacaaaggaccagctcaactctcctccaggtttgagccctacaaaactcagacacagactcagatattgaaatagtacccaacattgacttaacaagagacagttcccatggtgaggacttgaagcataaattgaattcaactaagttacatttcttgcatacctgagtttgtgctttgagaaatgtgtactcatttctcaacaacaacgtgtacagactctcttctattattttttctcattgataattatttaatatcactgttcattgtaatagagtctgtacttctaacatttttcatggcatagaatttgaccaagctgctattcccacaatttctttcttggccagataggtttcttggtttttgtttgtttgttttggtttttgttttgctattagtcatcaaacagcaaacattgaatacaaacagtttgtttttttcatttattctcgaaaactgttaagcttcctccttctctcttctttcatttattctcttatcaacaagcatttgttgagcccctgttgtgtgtgtggcattgcttcaggtgctgggattcagtggtgaactgatataagcttgcgctcatggaatctacatcctagcagggaaggggacatgaaagatgaatagatattcagatataagaagtaggagaaaaaataaagtaggaaaggagatggaaaattctctccaagaagaacagaaatttgaattaaataaaggaatcagctatgtaagaagctgaggagaaagttcgcagacacaaatagcaagtacaatgcattctgcaagaatgagatagcaacaagcaaaatgcatgtcccaaacacatcccagtgtaggtaagacaaaagaaggtcatgggatgaatgagaggcaacagagggtagtagttagaacactgctctggaacccggctgcctgggtttgcatcctagctcttccacttatggtacacagtgtgaccttggagcttcagtaacttttctgtgcctcagatttttagcctgtaaagtagtgagaatatacttatcttgtagagttttgtgaggattaaatgagtcaggtcaagcaaaatgcttagaaccacgactggcatgtagtaaatactcatcacatttggctattatgatttactaggttgtaaaatctatgagggcggagatgtgtctgttttgctcacagcctgacctccattacccagaagacaagtgcatgcacaaaggtgatatttgggtggttggcggcgggagtgatgctaatttataacagtgtgaactgataaaaaggaagaaaataagtaataggcaaatatgttggggtagggtagacttcccctcaaggaagatgctgtgacagtagagtaagaaaggccagagaaacaatgatgttttaaagaaaatctgaggagaggaaaccttaggttaaataaaagaggtcaaagttttctgagcatagggcacatcatcttctctggttggatgttatattcattacacacatgagacacctgaaggatgcttcatgctgccagagtcgtaataggatttataaaggccacctctttaagagggattatgcttaagaaagtttggcccaaaccaacaggagtttgacaattcactgaactcaaagcatgtgaaccttctatgcttggcatgcaagctgagatttcactgttgtccaagccagaattccagaagctgggtcacagcagtgagcttactggagtggtgagtgccttaaagaggaagtgcaggatactaagtgaaatatggtaagatttgcctggagccagggaattatcccaggctgaaaggactgcaaagcagaagagagaataacatttgaaggaatgaaaaagcctaatgtagctgtaacctagagaaccaggagaactgaaaataaggctagagggatgagttggggccagatcccaagaaactcctagactgcattaaggatatgggacttcatgctaagaggagtgaggtgccattaaaggattggaggcagggaagttacatttgcattttataaaagttactctggatacttgtagatataagaggggaagtatgttgtcagggaaaccagttaggaggaagccaagtacaagatggcagtgcttgaactctggggtagtgacagtggggctgatgggaaatggaaggatatgagagctatctaaggggcataagattcaggacttgatgatgcatatggttctggtataagtgccttaagatatgctgatacaataactcataaagggagcattttaggggaagaagggggctttaatggggaaagatgaaagaagattatgagttgagtctgggatatattgggtttcaggtgcccttggagcatctaggtaggggtgtccagtaggaagttgactttaggatataggggtctagaacttagatgacaaagatggcatatatatatatatatatatatatatatatatatatacacatacacacacatatatatatgtatatatatatatttgaaagcagtttgaatgtaagtggtaattttgaaaagatgcaactggatgagttaacacagaagggttgaagtaagaagagaagaaggcctcagacacagttctaacaaactaaatgtttaatagttaagcagaagagatggacccagcagaggagactgaaaaggaaggtacagaaataggaaaagatctagaagaatacaatgcagagccaagagtaaaaatttcttcagaaagaatagaaaggccaacagaggcaatgctgtggaaaggtcaggtaaaatgaaacatgaaaaggtccaggggctttagtcacatggatgtctttggtgatctaagcaaaagaggattaatggagtaaaagggtaggcagaggtcatattgaaggggcttaaagagcgggtgagaggtgaagaaatggagatatggtgtacagacaattttttcaagaagtttgcctgtgaggaaaaggagatagtaagatggcactagggagtagggagaattgaaagaagactttttggtttttgtgtttgggggagtttttgtttgtttgtttgttttgagcatatttgcatgctaatgggaaggatctgggagaataagagagactgaagattaagggaagaaagggtatattcaacagactcctgcagtggcaggagagaatgcacagtggagacactggtgttaacaggagcagggggacctctttaagcgtaacaggatgaagggaggaaagttctctctgttatcaattttatataggagatccttttgaggtggggccatggtcatgttttaagctggcaagtagatacttttagtctctgtgtctctgcaatcaatcaagttcaacaatgtcaaggctgtttacaaagatgcctctcttttcccatcatgcctcacaggtggctgcttcctgccaaaatggcacatctaaagtgtcctcattcatgactacttcctgtgcttctttttagtgccaaaataggtccagggaagttcttgcttttgttccaaacagggattgttgattttggtcccaggatgtgccaacttctttagagaactatgctttgccagtttggacatctgtagtttctaaaatccagtcagtgattaaaacagcatgacagtgaaaataaatagtctgatctgtggaagagaaatggacatgtgtatatgaaaacacatgaacataaatggtaataacatgacaaaaatgacatttcaaatcttgggaaaatgaaaaattattcaataagtaatgttgatataaataatcagagacaggaaaaaataaaccacatcaatatcttactctttacccaaaataaatttcaaatgcaccaaagttttaagtgaaaaaagtgaaactacaaaagaaagaaaaaaacatggagaaggtattttccaagccttgtagtgagaaaagcttcatatgtaaggcatgtatgcatatgtggctaacctgcataatgtgcacatttaccctaaaacttaaagtataatttaaaaaaagaaaaaaatttaaaataaaaaaatgaagaaaattgaaaaaaaaagaaaacaaataaaaatactactgataaatcttgactacatacacatttttaaattatcaggaaaaaacactgttagcaaaatttgggggcacacagttatttctctaaactgatttttcaagtgcatatagtaaaaaaaaccctaaacactgcaagtgtgtatgcaatgacaactatgtctccttcccactatagacccttcctgctccccagactcctggtgcacccccctcccactccagtttatcttatattcttcaagcaatgttctatgcatatataagcacatgcatgcacatacacacactacacatacatatttttctacatcaccacaaataaatctgcctcattctttttcacaatgtattatgctttatcagttgttgttttccattattattataaacaatggacatcatctttctttgcccacataggctgatatctgttcaagatgcatgtcttgccgaggaatttatagataaacctaaagctaagaaattgccctccatcgaggtgaacacagttacacatccacatggagatttaacggaggcaggtagagagataagcctagtgttcaggaagggatcagaaattggacacataatttggtgggaattggcatagagatggttttttagggctatgagattcaaaaacacagagaagctaaggtgagaatgcttgagttattcaacatttacaagcaggaaaggaaaagggagacaaaaacagaaagtgaaaagaagtggagaaatatgggagaaaaagcaagagatgatgcagtccccagagccaaatgaacactggtttcaaagagaacaatataaattctgtcaaatgttataagggtaagatgagaactggaaatcaattatttgaatttggaagcagttaaagtcagattccaggggctgcagagaaaaaaagaggtaaggagctgtagaaggttaagtgtagaaaactcttgcaaggaattttactgtcaaagaagcagtaatgaaagagagcatggggtccagagagactttttcaaagccgcgagataattaaagcatgtttacctgctcatggcaatggtctggaagggagacaggtctggatgatgcaggccttgaataggtgggagaggaaagagcccggcacaagtgggaggggtagagccacccacgcactgtgtggggcacgaagacagaataccaggtggacttgcagatatgccagagatttagtggtaggaagaaggggaagttcttttgtgaactagtctatattctgagtgaaataaaagggagctcatcaacagagagtaagtagaaagaagagccggaggttagacgggggaagaggaagtgagaaacagtcatctggaagaatgaaggaatggaatataatatagaaacacagccagatttctgggcagggcaaggctggggctcacagatctctaggagggttggtaagcatagttgtgtattttttccagccaggtccagctggttgggtgcaagtacagagtagtctacaaattgggtctattcacagttcaggttttgccaggcaagtacaatgaaggaggagaggggcaaaggaattgagggtgcctacaagggagtagttagagagatggatgtgaaatctaagctgggcaaattgagaagtaaggacatgatataggtgatgggcagtaaaaatatgtaatgtcagcagtttaaaggactggatggggcagatattaattggagttgcaggactaaaggagttcaaaatataggaaatgaataccagagacagagagagggctgaagtcaaaatgttggaggtggtacttattattaacaacaaggtctagaggatgaccgcagaattggggtccaaggtgacacatggctgacagctgtcattgaccacactataatgcagaactcgaggagtctgaacagaagtgcccaccctgcttgaccagcttgtctcagaagtatctgatctgggattgctgccccatgtgggtgaagctcaagacaattctctttgggcttgtgacggatccctttgcagagctcaccatcaccttgtgcatcgtggtgaacaccatcttcatggccatggagcaccatggcatgagccctaccttcgaagccatgctccagataggcaacatcgtgagtgctctggctggtactgccctcactggcgtggtcggggcggggtggggatgatggcagggtgcagttcgggtggggtggggcatgcccttattggttagtgtgttgagccagttagctgagagcagagcagcagtgcaggagacatgtggacactgggttcaggaggtcaagtgtgggaggacccaggctgagctggtgggaatggctttgggatgaacaagcacaggaaagtgaaccaggagagcctggagccagaggcagctagttgccctttacaaaacataggacaaccacttgaattttctggatctcagttgcctctaccttgaaatgaggataaatgtcacttttttatctaaagacaatctttggacttgtctgtttccttccaatgtaattacttttatgaccacaattaacagtagccacgattttcaatgttgtcacttaaggagaaaaagagttggggagggaaggggaagacagtggaagggaggaaacatggaaacaaggttgctgttgtaacaaaagcatcaggaagtcggaacttttctttggcatctagtttagacatcatgctgctttaaattttcctccatcacttgttagtattatttactcttaacaagatacaatccatactggatttcactatatactggataaagtatctgactcagagggacaacaactgctccaaccttgccccacccacaggaatagtaataatactcagatgcttctcatggattatctcattttattttcacaacaaccctacatggtaggcactcttgttattccctttcccagatggaaaaatggagatgcaaaaggttaaataatcttcccaagatcatagagttgagtttagtggccacatcagaatttgaacccagacagaccggctgccaagcccgcttttcttaacccctgaattaagccacctcacaagacttgcgtgtgtgtgtgtgtgtgtgtgtgtgtgtgtgtgttcaaacacacgcacacatgataggcagaagctagaaagggtcagcatcctgccttcatgtccgcagcagggtccaccaagctggaggtgacctactggattcaccagaactgtctggctttggggtccagcttcttataggctgcagacttaggtggagggggaaggcccagaggaaatgtgactacttgtccctagaaaccactccctccgccataatccagggctgtgaaaggggcagcagtaggttctggaacatggtggaatcagcatgcctcatgttttggcagcacctaggctgaggtcacatcctaaagttgatatgaaaaggaaaaatggaaagagaagagaatgcttattcccaagaagtcagcctaagaccacagagggccttatggaatagacatttgagcccacaccctcattctacagttagaaaagtggaagcaagagagagaaaaggcctttcccacagtgtcagaggaaagtgccacttttttaaagcaagaaagtcatgtgcttggtgcctgcaatgagtcaggtgctttatgaatgttatttcagtgtcacaacaacattatgaggttaacatcaccctcacatgacaaaagagagcactaagactcagagaggttaaatatcctgcccaaaattgtatagctggtgagggtggatccagggtggacccaggtctctggaagacacaagacctcaaccctaccccccaccacaccacactgacttgcctacaagggacactccatagatactctttgaatcagtcttgtggcatgagaaagtcacttaaactctcagcctgttttcttctccataagaaggatgcattgtctgtttctcaggctggtgaggggctcagataaaaagatatgaaggaaaagcacctgaccctggtcgttgctttcctccttctctgtctcccttccctgctggttgttgtgttacccgagcctggttctgacctctctcagtgtcagaattctgtcctatttaagacaattagagacacacagagcctaaaagaatcttagaggcaatgaatcattgttcttactagtcactgttacttatgaatgaattactgtctgccaggccctttgttaagaactgcacatgcattggctcattttatgcccattatacagatgaggaaattgaggtacaggaaggatgcattatttgtccaagcttacataagctaggaaatgtctgggctgggattttaatccaggtctgtgatgtcccacaacccacacgttttaactactgaaccagactgactcttcactgacaaaatgatattataataatgatcttaaagactatccgcttattccactcccaccaccattcacgtggaaaaactgcagcatgcacagcccctgagaatggtgcagaaatgtctccattctgtcacgttgactgttaccctggccaatcctcaggagcccacagataacatagcaactgaacaaaacaaaaggattttctattttgtaaataagacattttcttgctgccatttttatcattgcctccgaccccacagatcccactgtgatgaaagcttgtttccactcctaggtctttaccatattttttactgctgaaatggtcttcaaaatcattgccttcgacccatactattatttccagaagaagtggaatatctttgactgcatcatcgtcactgtgagtctgctagagctgggcgtggccaagaagggaagcctgtctgtgctgcggagcttccgcttggtaatgtttttctcttgatggcttggggaaactcccacccagattcagggaagacactgtgctctggggactgcaccagccagctcccccttcctctcctgtccttgtgggagggagcagggtctgactcctgggcgactggagacttgggtctgtggccccagcttttcgctgactcagagtggggacatgccttctcctttctgggccttggctcccttatctgcaccaagaggggacttccaagcactgtcctcgtctcttatcaaataacaataacagcaataatcacagcagctaatacttactgagcacttacaatgtgtcaggcatagcactggacacttgaaaaaacgcacctcattttatgctcacaacaaccctgagagatagtcgtttttaagatcctcaggggtgggtgaggaaaaagaatggttccatgatgacccgaaagtctcccatctgccaagcaagcgaataagccacagacctggatctcaaatccaggttgtctgactccagagccccagctccttccagcctcaaggaagtcattctctgattcccttgtgcccgaaatcacagccccaatgtctcaagcaccttcaacctgcctattagtctcactcacatgcaatgatggctcttctctaaactcagctccaggacgccctctacaggagaagtgccacaggccacccacttttatcagagccacaggtttgtcagccaaacctgtcagattcccaggagtgtcgggtcactaggtctccaggccatctggaggaagcttggcatctcactgactcttgggaataggaaagaggcctgaagaaatgtcacggcttgttagcgcaggccgcctgctctcaggaatctctcagtattaactgggagccctgcatctagacttgaagagaggtgacaaaacaaaggggagtatccaacaatcttcccaaggtcctgacaagtgttggcatccagaggttgaagggggtgcatggttcaggaggcaacgagactctaggacagatctgcttgggaccctatcacaggggccagtgagacagtgctgagcccctgaacttggcgtacctggattaggggtggcaaactcaaatgcccatgtgcagtgacatagagccagccatggaagagatgtgggcactggatatttgcctcaggtagacaggcaaagatgactccatttcacctaggcagacccaaagcagtgcacaactcctgggagggatgtttacatagaaatcaatgtgaccatctcaggccaggtgcagtggctcacacctgtaatcctagtactttgggaggccgaggcaggcagatcgcttgagcccaggagttcaagggcaacatggtgaaaccccgtctctacaaaaaatgaaaaaattagccaggcatggtggtgcacatctgttatcctagctactcagaagactgaggtgggaggatcacctgagaccagggaggtggaggctgcagtgcaccatgatcgtgccactgcactccagcctgggagacagagtaagaacctgtctcaaaaaagaaaggagacacagagagagaggaataaagatagaaaaagcgagagaaagacagatgaaagaaagagagagagcaagagggagagagaaagaaaaagagaaagaaagaaagaagaaagagaaagaaagaaagaaagaaagaaagaaagaaagaggaagggagggagggagggagagagagagggagggagggagggagagagagagggagggagggagggaaggacgagctatggcctgtccattattgtcagagttactaattttccaaaaaagtcagaaatccagatttttgtgcaaatgtctttaatattggctactaatccagtttttaaaaacactctaaagaccaaataaagcatgtcctgagacacagctgtgccatgaaacgctggttgatggcatctgcctaagctgatggtactgtcaccatcccagggaggagaagggtagagtaggcctggtaggactctttatccataacttgaaaatcttacaaggtcagaattaaatcacatttttagaaggacagatttctctaggtatctagaaattgatgtcaagatgtaggcccctaagctaatggtcaatataaggtacctatgcacaatcgtcaagagagcaggagatatcacacccccataccctggcaggcccacagttagttttctaataaaatacgaggctgggcgcggtggctcacgcctgtaatcccagcactttgggaggccgaggcaggcggatcacaaggtcaggagatcgagaccatcttggctaacacggtgaaaccccgtctctactaaaaatacaaaaaattagccgggcacggtggcgggcgcctgtagtcccagctactcgggaggctgaggcaggagaatggcgtgaacctgggaggcggagcttacagtgagccgagattgcgccactgcaatccggcctgggctaaacagcgggactccgtctcaaaaaaaaaaaaaaaaaaaaaaaaacgaacatttctgctacacttggggaagcagaagcttagtgttttaaggtctatgtgctacttttgttctgatcccacagtctaaagtcccaaacaaccaaaaataggcaagtttacttcacagtctgcccctacaggattctgcaggggaatgctaccctgtccccacctcgctgatttaacatgctgatcagtgctcaattccctaaccacacccaccaactacacactttcttgggatctattccacttccctcatgacctagcttagatttcacagcccaccaatattattatgcccttgaaaacaaactcaatcaccttttccctctgcctctttgcgtttttgtgtttgccaaaacctcaccggagagtctaagtcaaatatttctctccaccttgtctgcacctgagctgtgagaaatgctggagaaaaatcaccgccagctggtcagtttcctggttttaattaatagactttattttcaggacagttttcagttttcagaaaactggagcagattgaacagaaagctttcatataccatcaatcccacaacacacacacacacacacacacacacacacacacacacacacacagagtttccctattaccaacatcttatgttagtacctacatttgttacaaataacttcactggtttcccattgctctgagaataaaatccagactcctcatgatggtgtacaaagttctgcataatcaggacctgccagttcaccagtctccgtcttgcccactttgctccagccaaaaaggcctactctctcttcttcacacataacagagaacttcttggctttgggcctttgaagtttttttcgctgtgcctggaatacttttcctttagtcttcacttagctcacttattctcaaactctgtgttcaatgcacttgtcacctccttagaggggacctccccaaccacactatctaaagttggattccttcatcaaattaacctggcatttacaattgtcctgctatcccatgaggcaaaaaccagagtttcttgtctaccgttttatcccaagggcctagcacaaggcccagcacatacataggaactcaataaacacctgttgattgattgaaggaaggaaagaaagagaggaaggtggagggaaaaaggaagaaataaaaagtctgtcttccttctctcccaaaatagcattgcttctcctcccgtcacttaaagccttgctccatttgctctgttagtccattggtctatcctggcaccaatatcagtcttaattatggcagctttaaatatatctgtgtctgtaaatcaagtaatccacctaatttacttcaagaatatcttggcctgcacactttcatattcactttagaattatcttgccaagttacatacccacatacacacaaaactgctattgtttttcccattagggactgctgtaattgataggtcaatttgggaagacttataatctttacataattcagtcttctgatctatgaagatagtatacgctgtataccagtctttcaataaagtttaaaaatgtttccatgaggtttttataattttctccataggatcttgcatatcttcttaaatgttcttttctggcatttttggctagcattttgatatttaacatttttgtatctagaaatgtctcttattaattctaataatttatctatacaatgttttaaattttctaacataatcacatcatgtgaaaataacaatgagtttaatttcttcttttctttcttttttttttttttttttttgagacagagtctcgctctgtcacccaggctagagtgcagtggcgtgatctcggctcattgccagctccacctcccgggttcacgccattctcctgcctcagcctcctgagtagctgggactacaggcacccaccaccatgcctggctaattctttgtatttttagtagagacggggtttcaccgtgttagccaggatggtctcgatctcctgacctcatgatctgcctgccttggcctcctaaagtgctgggattacaggcatgagccacccacgcccagcctaatttcttcttttctaatccttatgccattaggttctttttactagatcactgtgctagttaggacatccagtacactgttgaaaagaagtgttaataacaggtatctttatcaattttctgatcccaaaaagaatcctttcaatatttcaccacctctaacaattgtggcaggctttttttaaagataagaaatctttatcagttcaggaagttctcttttatcaagaatatttatcatgaatggatgtttaattttatcagacaattattctacatgtattgagataatcatgtattttctccttcaatctgttaaagtggtgaattatattaattgattttctaatgttaaatcaactttacattcccagctcaaacctagcttgatcgtgatgcattttttaatacattggaagatttagtttgctaaaaatttgcttaagatttttttatccatatcaatgagtaatatttgatctataattttcctgactttcattgtccttgccaggttttggtatcaaggttccaagattatgccattttttttttaaagccaagggggccaggtggggtggctcacgcctgtaatcccagaattttgggaggccaaggtgggaggattgcttgaggacaggagttggagaccagcctggccaacaggagaaaaccccatctctactaaaaatatataaattagctgggtgtggtggcacacacctgtaatcccagctactcaggagggtgaggcatgagaattgcttgaatcccagagacagaggttgcagtgagctgagatcatgccactgcactccagcctgggcaacagagcgagactccgtctcattgaaaacaataaaaagaaggccaggggcagtggttaatgcctgtaatcccagcactgttggaggcgcaggcaggcggatcacctgaggtcgggagttcgagaccagcctgaccaacatggagaagacccatctctaccaaaaatacaaaattagccaggtgtgatggtgcatacttttaatcccagctacttgggaggctgagggaggagaattgcttgaacccgggaggcggaggttgcggtgagctgagattgcaccattgcactccagcctgggcaacaagggcaaaactccatctcaaaaataaataaataaataaataaattttaaatttaaaaaagaaaaggaaagaaattagctgggcatgatggcacgtgtctgtagtctcagctatttgggaggctgaggtgggaggatgacttgagcccaggaggtcgtggctgcagaaattacagcataaattaactctccattagttaacttaatcaaagccaaaagttagctaaaatctttaaccttcctccaagacaacttttcattccagatatcctttcccaatttattgtaatgataagtattttaattttatcttgtttataaaaatttttattaatcaatgaaaaataaagctacctattatacagacaatctctaaaactgagtaactgaccccaataaaggtttatttctcactcgtatcatagcctaatgcaagccagacagctctaggtgggactccaagaagtgactttgccatgcctgaaggaggccaatataacttcaaagtttgcctcctgcttgtgggaaaatggaaagccaaggtttgttttaaggtttaaacagtgaaaggctttttcagtcagggattttgatttatttcacaatacaattacttcaaaaacttagatggcttcagacctctcattgccacacaaagtgctttctttgacaaagttctcaattgttctttatttctttgctttcctttccccatgcctttctcttgcacaagaaacagtggctacaccattactacaagctttgctaagagttgtttcatttaattggaaaatttaactagtcttcaacatttgaagacttaatcccattgctcactgcctggaatctagaagcagtacagttccctaaatcgtcaaggctctaaacttctggattatattttcttttattcttataaaccagctaaatctttcctgagctaatctctttcttgtactgtcttgaccaacatagccaattacaactgacccacaatactaaggtttaataaacccttcccctagggttgctggttcatgaggctcgtgctctgcctcaaaatttttgccagcaatatttttgtcactgaataacatagattgacattccaagccttctcctatcagcttccttgttgcccaccacatgatcattaagccagtgccacatagttgatgcttttgaaaaggcaataccttttttcaatgaagcaatttctccattactcaagataagtacaactagctgcagtgataccctctaaatctgtgagttaacataatagagatgtatgtctcacagcacattcagtgcttgttgggaagctctcctgggagtgtctacttcaagtagcgcctcaaggatctaggattatcccatatcgtgatgtcaccatcttcagttagtgacctttatggtgaacatgaaagggaaagaaaaagttcagggggtttaaggctatgcctaaaagtcatgtatattacttctgtctccatctccattccaccagacagaacccactaacatgaccccaactatttgcaagcaaaactggaaaacagtcttccgttgtgtctgggaggagaaaagtgaatggagactatatgaccagtctcttccacatctcacaagacattgttgttgtgtccactcaatgtttatttagattcactctcatgcttagcactttcttgctctttatacctttgttatagagccagtgggggctcactgcccaatgctctagaagccaatactatgactttggaagccaagacgaggacaccaggcttttgagaaaagaaaagcttaatactgcaagctggctggcaagaagacaggaggtcaagctcagatctgtctccctgtgctgtcttcaaggcagtatttttattagaaaatgtttagtgggtggataccgggatttgcaggtgattggtggaaggaaaggggaggtttggagagtccatgggcctgcacagttatctcttcatgcttactcatgggttgcatatgcaaatctggggggagttagtatgcaatatgaagtggaaattcagtccatgacgtcagcaagctcattctgcacaaactccagtcggccatcctggttccaattgatttcagcctgttttttcatcatcacacaaggggagggagtttcagtgtctcagcaagttgtttctttacctatctgctatcctaaaaactcaagaatttttgtaagttactgatttcttactctttggaacacagtttgagtttcagattttcagtgagttatttcttatctggtatcctgtaagcctaaaaatttagttattgatttcttcaaccctttggagcacagtttcacattcttgtatattacacattacatattacttctgggatcactttctatctacctgaagtacctcctttagaatttcttttagtaagtgccttctggccataacctctttgtttatctgaaatttgctcttcagtttgcccgtgtctttgagagacatttcttatgaatgtaaaattctagttgatactttatcttccttcagtgaagatagtattccaacaattagcctccattgttgctaatgagcagtcagctttcaatttaactgttattccttcctttctggatgctttttaaatcttctatccatctttggtgttctgcagtttcactgtaatatgtctaggtgtggacttctttccatttataatgcttaagatatactgacttcttgaatctttagttttgtaattttcttcaattctggaaagttcccagacatgatgtgggcagtcatagcctccacgccattctattttttctccttctggactttggttagatagatgttaaactctctcattctatcctctatgtctcttacactattttgttatttttcatcttatgtctctctaggttacattctgaataatttattctgatatatcctcagttcactaattctctcccaaactgtgtcaaatctgatgcaaaccttcttcataatatttttaattttaagtattatatttttcatttctaagagtgtatttttcacaacttgttattgttatctatagtttttttattctctgcacatagtttcaagttattattttatttctttaacatattatatctaattatactgttatctctgactaataattctatcatctgaagaaatggaatgactatttccacatctgtggtttcttcaagatctcattcactcttgatgactcattccttctgtttttgtttgtttttttactgcaactcttaaacaatttttgagggaatagtttgaaacctgagataaaggcaggttcctccagaggtatttgcatttaattctgcagagcactttgtagaattgctctaaattaaattctcaacttaaaatacctaggtagtgtgaattccagataaaatcctatatgagcaccactttgttgtttcaaatgctcagcgtcaattttcctcctgtagctggtacctaacaccagccattcaattttccttgcattctcctgggattgtttgtggttcatccttacatgaagggtatagctctttgggatctagtcttaaagcagggagaaattcctgctaggcttacaaccttcggcaggccatggactacgtttcctgctccccatactagttactaatgctcagtttttatttgtgtttatcagctgcctctgtgaccagtccacagagttgttgttttaagctctgcttcccatatgaggagagtaacttccagattgggtgtaaggtgaacgtggacccgctctcccccatcacataaagaggtgcatacagcacttactgtataacaggattaaacctcctcccgtgggatttactcacggatatgggtgataaaattgtagctacactgttgtgttcagcattgcatcctagcacctaagccacagcctggctcttagtaggtgctccataaacacaccttgactgacagactgacagttgagctcagattttttttcctgacaaattagagaaccatacaaatatattttaaaacacatacatttttatgcttgatgattttgctgtcttgtgggacttagcatatttgagtttacagtgaagacttttgagacttcatcttttctcagtaactaaaccattggttccatgagagcaagagcccacacacctctcttcatacacctcataggctagcacactgccatgcacctgcacggctggagttctggggggtaggttcgttggtcaattaaatcaacttatgaatgctgagtccatgaaatcatggacatttgcagtttcaaagctggtgggagcaacagatgttgtccactgccccaagatgagaaatgccctaagagatgttttgccaatacctatcgaatgcagtgggtcatcccctacccgaaggaggctggtctctcttcagtcataaataagcttgttctcacttatttgtgagccccatcacacccaccccacctccacagaagaggcccatattcaggagggatcaggcctgtggctatagaacagagtacagatcgcaaggccaccaccccagtagaagaccctgactcagccacagtcaatgaagcacattgatacttatgaaccatagaaggcagatcatatttttgagtaatttatagcataggaagaaaggtctccaaaagcagtgtccagaaaacgccctggtttaatgggatgagaggccttgtgtttttcccagatctttggtttccaggcaaaactttagatgaaaggtaatgagcacagctaccaaaacctgacggtctctgtttctctgcagctgcgcgtattcaagctggccaaatcctggcccaccttaaacacactcatcaagatcatcggaaactcagtgggggcactggggaacctcaccatcatcctggccatcattgtctttgtctttgctctggttggcaagcagctcctaggggaaaactaccgtaacaaccgaaaaaatatctccgcgccccatgaagactggccccgctggcacatgcacgacttcttccactctttcctcattgtcttccgtatcctctgtggagagtggattgagaacatgtgggcctgcatggaagttggccaaaaatccatatgcctcatccttttcttgacggtgatggtgctagggaacctggtggtgagtggtgaaccctgctgggggcactgtctcctggggaaaggagaaggcttctgggttatctgaaaaagctttgatctgcatttttatgcccagattgtacttctctggttgaaaagtcttcaaacttttcaaattcatgtgggattcattacaagaagtgtgccttgggaggcagtctgacttgcaggaatgagaacatatgattagaaaagaaagacctggtgtagaatctctgctccaccatttactaggtgggtgaccccaggcaagagacttaatctcctcaagatctaatttccttaaaatcaagaaaataatgcttactcatgggtttactgggagaattaaatgacaggagatgacatatgcaaattgcctaatgcaatgtctgggctgaggcaggaactcaataaacggtgtctattagctgttaaaggaaaaatgtccttccccaatctgagggggctcagaaaacatttttattcagggaagtaagagctgactgatttctccaagctgcacaggtcctagctgggagcagggggagaggctgcagggagggggcacaatgggtcacggacaacatccaaggccacagaaataataacaaaatctactccatgtttggaggaagcccctctggagactcacttgccaataagccccaataccccttctccgccccagcctggccccctgccctcagcttgtctccacccactctggtcatggtggggtccttgccctcctgggactgactggttgtgtgggaggatgcagtcttccagaagcccctttcttattgccctggacatcaaccaacttgggttctttcctcatgagttttatagacagaagaaagctaaaccaagaaaagggaagcaacaacaaatccagactctttagtcttttccaccctggtgcctgagccagggatgcctctgcctgcatcccagaaactctgttcttccaggctgagcccaccatccctgcagagccacagatgcccctcaccctcagacaggaagtttacccctctgagcacttttacatttctcatatcattttgtcttcacaaccgctcttcatctgctctcaagtgaagaactggaagcagcaagatgtgcccaggattccagagtcaggaacagagcccagggctttggcacatgagggtggttgcaggaagggctggtgccttctctctgttgtccctaaatgtccctctgctcagcggggggctcctcctttatggtggaaaatatgcttccaagcctcgtccactgaggcgggtcactccaggacatccccaaactttccctcaactgctctcagaaagtccattcccccaaaagggacagcatcccgggtgggcaggaagaggcccaggccgtggctgtcttgccagccagctgctaacccggtaggccaatgtggggctcagcttagagattgatcaatcttcccttccattccttctcttcaggtgcttaacctgttcatcgccctgctattgaactctttcagtgctgacaacctcacagccccggaggacgatggggaggtgaacaacctgcaggtggccctggcacggatccaggtctttggccatcgtaccaaacaggctctttgcagcttcttcagcaggtcctgcccattcccccagcccaaggcagagcctgagctggtggtgaaactcccactctccagctccaaggctgagaaccacattgctgccaacactgccagggggagctctggagggctccaagctcccagaggccccagggatgagcacagtgacttcatcgctaatccgactgtgtgggtctctgtgcccattgctgagggtgaatctgatcttgatgacttggaggatgatggtggggaagatgctcagagcttccagcaggaagtgatccccaaaggacaggtaagagttatccccaagggacagccacaggcagtggggaggggcttcagggcttgagtgacaaagggcaaaagggaaatgcagaggagaccttgacataaagaagtttaaaccatgccaagctttccagaggagttggcgtttgagcagggcctggaagaaaaagtcagaattccccaggcagacaaacagggagtggggggcagcaggtgagcaaaaggccaccttgaggtgcttggggattgtctttcacacagctgtcccatgcgctctgcccaacccaggctctgtgcatgagatgctaatgagatttctctaagaacaggatgttgtccaagagcaaggctcatctaatctttaccagcatcctaagaagtcctgattcttatgtgactcatttagccagcttttccccacaagtggtatcacagggaaatgacacgctccttttggcaccaactaatttaaagcacatttgagccatttgataatatatatttttaaatacttggcactattccttactaccttaagctggtatatcaaccctcgctaacctcttctcagtaactcagggcattcacctctgcccaacgtgggaaggcagggaaccctgtgaggcctcaggaacatgcagggctgctggccaggttactaagtggtccagaaaagctgtgctttgagtctgtagctctcccatagccttcttccctgcagtcgtcacttgtgttccagcagctgctgttatcagctgccatattttacatgcctttgtctaggtaacagcagagagcatgaactctgtgacagctgtctgccactcagaagcattttcagttactttggggctcttagggagctccaggtggccaagttccctacaattttgacctctggacaaataacaatggtcatggctaaaatctattgagccaagcacttcgtgcaaagtgttttacaagcgctaacatatttagtcatcaaaacagctgaatgatgcagatctagccttttcaattttgaagctgggaaaaatgaagattagagaggttaaacaacttgcctaaggtcacacatcttataattaatggagcccaaggataaaacataggtctatctagctatagtcttcatgctcacttcacacacgtgtatgtatatatgtatgtacatgagttgcatatatgaaactcttggctctggcagcctgtgatgtgcaagatcccttcaaatttagaactggtcatctaagggtggggccaggcacccagttgggaccctctctcactagcaggagcagctgcagcaagtcgagaggtgtggggaccacctgacacccaggagcccaggcactggaacatcttctgaggacctggctccatccctgggtgagacgtggaaagatgagtctgttcctcaggtccctgctgaggtaggtatgtcagcttcctggagaggttggacagccagccagacactgagcagtgggctggtagaggctggagggtggcggtgaaggtggggtattccagactgcactcaatcacataacctcatttcttatcctgggaatttttaaagtccctcccaacctccggctaatccgcacaatttcaactttcaccatataccattgccacaatctcactccagggtggttctaggtatagaaagaaagagtgagactccacaagctgtgggacctaagatcagttcccaaacctctctgagccgccatttattcatctatgaaactgaatggtaatgcctacttggtaggattattttgaagcttaaatgagatgctgcttgtcaaatgtttaggtcctgcctgagacaaagtaagtgcccaggaaatgacagccaagaaaaaaggaaacgaaagacaacgcacaaagaaagtcaaatatctttcagagccagcaaataagagttggaggtgctcacagatgaagaagttttcccttgtgattctcccccactttcttttgtccacatcattttctctaggcaaaagtagcctggggctagggagaggctctctataggtgagtagtgaagtgacagcctcacagagactgagctggaagattagaggtttaggattgtcttatacaaggtaaaaataaatgtggtttcacttacaaatcttgaaggaaacaagctatagggaaagaggcatctataaaagtttagcatctttaataacactgccttcaattcaagaatttaatttgacacctagccactgagtgctgactttgtgacaggcactgggctcaacagagataaggaagtcataattcatccccaaagttatcaagcccttcagcttgaagaatgtcagctactggctgtgtgccctaggcaaggctgaccacagcagggtaagataagagggagggctgggacgggatttgggggctgtgggtgaacagaagccgcttggttcccactgggtgagggctgtcacattctgcacgtggatgtcatgcttcttcccaaatgttccaaggactcccctggctagttgtccctactcaatgttttcagtacacaacttctgggtgttggttttttgtttttgttttcttgtccatgaccccggctaggcaggaggggcctgacagcgacaaatggggacccgccccaccatttgggtccattagcaaagctatcaggtttactaatatgagagcaacttcaacccctaattgaattcatctggagacattatagggctggagctgccaggagggcagcaggcccctgcagcattactccatgattaaatattcaagcccagtgaatgctgagagtcgttatgggtgtaattacggtgtctcgggccattgccagcactccatcaggggccccgaaggtttacagtctcacacagctaagcctctggggctccagggagaagagcagtgttccaggcctcagctggcgaggcaccaaacatgggtgcagttgaacctgcagtgaccgtgtgcaattccccgggccccgcggagagacgagttcactgccctgggcttctcccctgcagggagtggacgacacaagctcctctgagggcagcacggtggactgcctagatcctgaggaaatcctgaggaagatccctgagctggcagatgacctggaagaaccagatgactgcttcacagaaggtgaagggacagccacaggccccctcacactgatgttaattagggccagaatccagttgagcgaacactcacctgggatccacagaagacaaacaagctgtgcccacttgctgcctcactcccaggcttgagggcgcccgcatcagacacacatgccccaggtggcagcagcctggccgtggtatctgcatctcatgccctatcagacactacggagagacgtgggccttcctctttaccctcaaaaacccctccgtgagttctaaaccagccctcttgagttgaaagggggaaacgtagtcaccaccataaacaccactgaaaactcttgatttggaccatgaaggacccagaggaaggccatgatgtatctgcttccctcaatcttttgtttagctctcaaaagcagaacctgtgtcttagtcatctttcctctcagtgtttagaacagtgaggcacattacattctcaataaatatttgtgcaatgaatgaatcaagagtccattctataaagggaattgtggcctcaatgctttctaaaaatacaaagaaaaattttttaaatacttgagtttttattaatagttttatttgaccctgggctgggctgagctgggctggacccaatccccatcccagccacgtcgtggccctcagttcagcttgggcttggagcatatccccctcaggcacccccaggctcatacgccgtagcttgtctgttttccaggtataggtgggcagaaggacagggaccactggtgtcatctgtaagaaggatatggctaggaaaaacatcagagtgggcaagactgatgatggagaggaacacctgttggtctggattgagggactccctggaagggacccctcttcacccatattccaggaaagaatttttttccaagggcatgacaagtgggtttcctagcagaatggtttctctgcagcaggagcagaaattatcccctttgcccactggccatcacccaccatcagtcacctctccccacaggatgcattcgccactgtccctgctgcaaactggataccaccaagagtccatgggatgtgggctggcaggtgcgcaagacttgctaccgtatcgtggagcacagctggtttgagagcttcatcatcttcatgatcctgctcagcagtggatctctggtaaggggaggcatagtccctgcccccaaatcctccagataggaatctcctacaatccaaaggccctggagctgcatcagtgggttctcctgactactgagctgaaagtccccaaccttgtcactagaaggagagctgcagcccagggcgagggcccctcttagcagcagagcatgggaggtgttcaaggtgcccgtgccatggcctgccaaacctggctgcaagcatttgagtgagtgagtgtatgcctcccactatatagatggggaaactgacactcaaaatgtttaaaaggcttgtccaaggtcacccaacttgtcagtagcaaaacccagctttgcccttatttaatcccgaagcccctggcttcccaccctctgacctccccaacacacggccttctctgaaggcctacaatacaaaaaggactatctttccttatcaaaccacttccaaatgctactaattactcctttaaagctcacagaaaatcattacaatagcacttctcaaaatttaatctcccaggagcttgttcaaatgcagattctcattccataaatctgtggcagggcctgagaatttgcatttctaacaagctcccaggtgatgcttgcactgccctcagtgacccacactttgaataacaaggccttatgggaatagagattcagagttgggagacatctctaaggccctggctgaatactgggctttgtagagcaaagaaggaaggttctctctgtactgtggcttaagctccttacacaatctcaactactccgccaatagaccaaggtagacatagacacaggaaggaacttaacatcctcagttgtttgcattttctaaatgaggaagtcaaagcccaaaggcatgaggggcttcaggtaattagttgaagggctgggaatagagagttcagggtggcagctaattagttgaagggctaggactacagtcccgctcttccgattcacggctgcagtgttttcactcatcttgcgcctcatgtgtcatttactctctaaaaacaacctactaaatatctaggcctccatctaaatgccagattgtccaggaagggtgacaaaactgctcggtgcatggcctcagctttagggaggagcacaggtgcgggacgaggcaggatctgagaggtgggaggaaaactagggtggcaatgacgcaaagccaagggagaagagagtttcggggcagggactggtctgccatcctgggtggagggggaactgtgtgacagcggctgcaggtgcccagtgccctggcacagggcagtgattgtccacacggacctcagcacagtgtagaggccaaattgcaggggcaagagagggctgggcagtgctttctccacacctatgctcttctccttccagtcctgctggattaaagtaataaccacatgtgctgttggccaggtgctctcctcactacgtcattggcttgtgggccttctctcctcattttgcttctctgctctcccttgctccctcccttctctctctagcccccttctcttcacaccccggtccaccccccacattcccaggaggaagctcagacctgcagcactgcgccagcccagcccgccccctgcagctctcccttccctcccatctccttcccctgggactgaacaggctggcaccaaatttagccttctttaggctttcactttgagtaccttttaaaaataacatgcattttcatctgacaaagtaaagtaccaaaaaaatacttggaaattatagaaaaaggtaaagaaaaaaaaatcatccatttccctatcactcaaagagaaactcacttgaaaacatgctggtatacctctttctcatcttgcttatgcataaaatatacacatattacaaaaataaaaccacatttatgcattctataacctcagtacatttttctcagtaaatagtctcatattatctcatttaatggctataacatattcctttataatttactcaaccaatctctatgtttacttctaatacacattgaatattccctgtgtgtactcccttagagacgttggataatctcccatcttagtcctcgtcctagacacagaatcggaagctgagaaaagatgtgggttcagttgaaatccggcttcagctgatcccatggaaagccctgaagcacaaaggacaccaaagagctgtcccaccttgaggcaaagaagacagccttgtaaatccccctgtcactgtccctggctgagggctgccccagcggggaggataagcatttcccaaggtggacacagtttcctccagcccagcgaagccatcaggaagggggtgtctgcatccatgaactattagcagccgacactcccagcagatgaaggataggggcactggccccttaaagaggacctgagtgggcaccaacagcctccagtgtccttaggattagtgcttgaaggaggaattgctaggttcctgaaacctctgagtcacattgccaatttggcttcacacaggactggccaggttttcactcctgccagtcacttgtaagagtggccgggcgcggtggctcacgcctgtaatcccagcactttgggaggctgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacctgggaggcagagcttgcagtgagccgagatcccgctactgcactccagcctgggcgacagagcgagactccgtctcaaaaaaaaaaaaaaaaaaaaaaaaaaaaaaaaaaaaaaaaaaaagagtggcagccccccacagccacagcatcctagggtttcccctattcttttccatctccaccagtctgataaaagaaaaacagcatcttcttttaatttgaatttccttgattaccagtgagatagaacattctttttcagaggtgtgttggcgattcttactttcatttttgtaaactgcctgtgaacatccgttgatgcttttatttttaaacaaagtcactgttagcatccctttggttcacttccaaaatccaatttgagaaggttttctttctcccttgcattcagcatccctgcaagtatcagcagggctgtttgtccccattggccctgaagaagtcatgctttggatctcacagtacctcctccactatcccactttacctccccacagcaaacaaaatgctactggcaagctgactaccaaatccccttccagggactgtggtcagggctggctgggtccttccctatcagtctgggccccagtgctgtgggtccaggcagcctgccattctgcatcctttcttccttccaggcctttgaagactattacctggaccagaagcccacggtgaaagctttgctggagtacactgacagggtcttcacctttatctttgtgttcgagatgctgcttaagtgggtggcctatggcttcaaaaagtacttcaccaatgcctggtgctggctggacttcctcattgtgaatgtgagtggctcagtgggaacacgtggggtttggggtcctcccctctgactcctggctacagctagggcaaaggaagctcagagacctggccctcaagggctactccaaagaaaagttttgagcatttagtgaggagtctgagaatagccctgacacccatgagtggtaaagtccaggcagtatgtgactgtgacacaatagtgactgttaggtgagttattaggtctccattcagaaagatccctgcaatcctctgcatttttacatccaaagtgagatgacacatgcagctctcagaggtcttatggccctgcatccatagatgggtcttctggaccttggggagccatgaactgtgagcacagagaatcttcccacctgcggttctgtggtcctcacacctggctgcacttgagaatcacctggggagctatgaaatatgcagtgaccgaccaccactaccccagagattctgatcttattggtcttgggtggtgcccaggcacctgtattttataaatgctcccaggcatttccaaggtgcagccatggcttagaaccactgagcttatactgctgcctcctccccagtggcattgaaaagaacagagggcgcatttggagaggtaatgagctggagttcatgtgttcacactcatggtaacctgtggccagtaatccctgcattagagaattgactgtgtgcttctcacacatcagacatgtgattcctcagtcatctcttcctcatcttaaccaccacattgcactatcactgtctaggccactaccttctttgctttgcagcatggttaactgagttatctgttcactgccgcatagctgagggtttctgcaagcagggtgaggcatgtgctgtgttggtctctgcctgccccactcaagcagctgccagcagcaaggtctgcccagcagaggtgtcaggaaatgtgtctgtatttggtgcttgcctcctgaagctggatgaggttcagcacagaacattctgtccagcctcctgtgctggcaggtcctccatagcaggcctgtgcattcaattctcttcttccctgatgccaatgcactagcagcttcaggccactgtaccacaaggattagctgtgaggcctgaaatctgagtcatgggtgataattctgtgcatatgaaataattattcataaatgaaaggaaaattatttattccggtgtcccacccctttgggggcacagtcactcctgcttatgttgatctcaccagtctcagtcctaatcaccttaaacggtcatgcactcatttcatccatcttcctactgattcttccttccaaccatccatccttccttccatacatttcaccttttgtatccaaccattcagtcttcctttttccttcctcccaaacatccatccatctttatttcttccagctgtacatcttcatcagtcctccccttccatccatccattcccattcttctttccctcttctcttctgcccaatcttttattctaaacttccttccatctattcatcatccttaacccttatatctttctatcttttgattcattcttctatccaactgtccaatcatctaacattctgttcactcattcacgcatcttccatccaagcatgcttctactcactcatccttctatccactcattcttctatctttccattcttgtttcaacctatccatctattcttcctttcttccacttatctgttcattcatccctttcccttccattcatcatccattcatccatcctatcaaccttccagtcattcactaatttattccattcatctattctgtccagctccccatctttccattcatgcattagtcattttacccagccatccatccttctcttatccacctatctcatctatccattcactattccctgctttcatacttttcctttcttgtttgtttctcccatccttccattcaactatctatcctatccatctttttgtgtctgttatcttttaaaattttaaaaaatatattttattgtatatatttgtattagtctattttcatgctgctgataaagacatacctaagactgggcaatttataaaagaaagaggtttaattggacttacagcttcacatggctggggaagccttacaatcatggcaaaaggaaaggaggtgcgagtcacgtcttatgtggatggcagcaggcaaagagagaggttgggcagggaaactcccccttataataccgtcacatctcatgaaacttattcactatcatgagaacagcatgggaaagacctgctcccatgattcacttacctcccacagggtccctcccctcccacaacacatgggaattcaagataagatttgggtggggacacagccaaaccatatcaatttttaagggatacaaaatgatgttataagatatatatatatataaatgattactatagtggaacatattaacatatccatcatctcacatagttacccatttctccccctgtggcaagagcagctataattactcagcgagcaaaaatactgaaaacaatatgctattattaactatagtattcatgttatacattaaatctatcctatttatcattgtatcctttaattcatccctctatgcaatcacccttcaacttttcatccagctgtacttctttctttctttccttctagccatcccaatgatcctatttttcttccatttgctatacatctaactattgaatacaggattgtcttatgaagtgctttgtaagaaacagaagcacagaataaatactcactatctccaggatcttacactttagtctttcagcagacaagacacacatggaaataaatgtattataagggtgaatgtgttgagcactgctgggggcaattagtatcttggagacacagagacatgagccttcttccactcttggggtggggtggttgagaattcttcctatgggaggtggcattagatgtggggcatagaaatgagcaggaccaaggagctgcgagaggactggggaaggcccgtcttagctaaaggctgaccttgaacaaaggcacagacacaagtatgctcagggaacaatttgatttgggtagaatgtgtgggtgaaatatgactggaaaagtaggttgtgaccatatgacacaggctacagagtatggagtttatcctgagggtgataaagtaccagtgatgtttgggagtaagagaaagacatgatcataatcagatttgcagtggagaatagatgcatggtgcagtactagggcctggagactacttgggaggctagtgggctgagcagtgggaatggaggtgggcttgggtggacagactttgctggagaggcacagcacctgtctgccccagctgcagattatccatgtgaggcagacttcccagggggctgagcaaaagactgaatagggttcagcatggaactggccccaaacctccctaccctcatgcacccaggcagctgggtctcacctgctgatgtctggagccttgcatgaatgaaggaagagggtcccttccattccggttctttgtcctggtgcaataagccactcatccaaagaatggacattgcttggggctctgccactcaagtataaagcccttcttttctgaagctcctgtgtgcatcccacctaactgccaggataagctgagcctgaattcagcccaccatctgtggtgtggctaagatctcacaggacagggtcatagcccgtatctatgacatctccctggcaccttcaaagttcctagcaggggaacttttttcatgtaagtttctgtcctttgcagtctttggaccaccacttaaagaaaactgacagaccaaaaggggctcacaagtcagtcattatatctcagatatctattgaagctagatctcatggacccataccagaaactttttgaagaactgcagagctatcagaactttggaattctcttagtctgactttttcattttacaaagggtgaaagtaccctggactagccaggcactaacccaagctcacaaaaaatcagggttcaaatgggaattagaccccacccaaaccactattctttccaccccacttctctgagcaaatataattcagattactatattcctcagaatagactctcagcatagcccctaggagggaacatcatgtctccaagtctctgaaaatcagtttcaaggttgttgaggcctgactgctgcccctagaaggaaaaggaagagttgatttaatacactggaagcttggccacctacgtaccagaggttggtgatgttagagactgagtttttcttgcccagattgtttaagagagtggtgaataaaatttttaataaaagggaagagacaaaactctttctagacctctcattggagttccgaataaggtgggagctaggatgatggcttagacgtgtaggaatgggaggctgggcagggagttcctgtctccttccacgaggactgcctttctggaaacctagagtgatgtttctgccctctcctgcactcagatctcactgataagtctcacagcgaagattctggaatattctgaagtggctcccatcaaagcccttcgaacccttcgcgctctgcggccactgcgggctctttctcgatttgaaggcatgcgggtaagtctgatctcaaaacttctctcatctggccaggcacggtggttcatgcctgtaatcccagcactttgggaggctgaggcgggcggatcacctgaggttaggagttcaaaaccaccctggccaacatgccgaaaccctgtctctgctaaaagtacaaaaatcactaccaccacgaggtgtggtggtagtgagccgagattgtgccattatactccagcctgggtgacagagcgagactccgcctcaaaaaacaaacaaaaaacttctctggtctgcaggttttggtaacccttccccctttatgccctccatcccaccaaccctgagctccggggccccacctccaaaggtaggctctgagtcttcacttcctgctctgactttggtggtgctgcatgtcctaactctcttagttctctttcaagtctttttgtgggcccatcttcccttgtcacccataaatattacagccaccaggacccagacctcaccccctttgctcttagtgaagtaatcctgaatcatcgctccacaagcatctattatctcaatcacccaactctgcctcttattgccaacatctccagaacatcccaagttctctgtctttccatgacaaatgagtctttcctctaatactccatgagtgacatcatcagctcattacctcagctgccacccactggaatgcttcttctctcctacttaatgcaatcatcaggtcctgtaaatttttcccttccatccacccctttccttatccaccactgtcagcctccaccttgccctaactgcctccgtcaggacagaatgctcacagccagagccttgtcttagagattgctgattgacacccacctcttcctcataattacaaatggctccccagcagaaagtaaggttttgctttgctccactatcattggctggaagtagtcatcatagcttcaaaaacaaaagtgggcttttgaaattaacttgtacctttacaaacactaggacccgaagattgaaatagtttgaaatttattctattttgtatctaatagattctcatttgcttatttacaaataagctattttgtgaatatggatttaggttttcactggttcttgaccacggcatactttaaattgtatttaaattgtgtttgtgttttatgtatggtatttaaggagaataagtcaaggttctagaagtctgtatgtgcaagtataatacacacactcacacttctaaatgagtgcagtatgcttgtaaactcatccatcttctcactgcaacccaccctgaatgaggttaagggaagaaggtctaaatccatcttcagctgcccaatgtctctcagtcttctgagtctgaattattgcactaattaacccacttctcttgcttcttccaaaggccactggctcatgaagcagcctgaatgagtatagaaagagatagaatccagcagagggggtggggcattgggaggttccaggtctttctctatctcccaccaggtggtggtggatgccctggtgggcgccatcccatccatcatgaatgtcctcctcgtctgcctcatcttctggctcatcttcagcatcatgggtgtgaacctcttcgcagggaagttttggaggtgcatcaactataccgatggagagttttcccttgtacctttgtcgattgtgaataacaagtctgactgcaagattcaaaactccactggcagcttcttctgggtcaatgtgaaagtcaactttgataatgttgcaatgggttaccttgcacttctgcaggtggtgagtcaaccatgagatcaaccatatctcttgctttggccgctcaataaaatggagagtctaggttcccagaagatgctatgtggggactttgcaaggagtagcactcagtgtgaactgaggtcattctctattcctacagactacaccatgaggctagagggccttcctagtgaatatgatatcacagtggtgcaattacacaagtgtgggctagtagaatagcataaagggatgggcctgccatgggattatcaggtggtgagttaaaacacagaacctgtacaaaatagacacggcatagccacatgttcagtcttcaacttcacatcatttcctaaatggtaataaattatgtctcattaggtctattgtaatgatatataatgttggtgataatgacagtcaaacacattcatcctgtctttctttctttcatcatccagtcaatcactcatttcttgccttcatctacctgttcattcagtcctctgttcattcaagtgttaatacaattacttatacatttgtcatgcagttactcttgagtgtctacattccaccattggttcttgcatttattcaacaaataatctctgagtagctctggtatgccaggcatggtactactcagccctgggagatacagtcagaactgggcttggacactgatgctgtatgagaaacagactaataggtgaattaaaacagctcattaagtgctgtaacaggcctaggagtgtaagaactaagatgtcttgcatgctctgaacatgctggaaggcacacccagtttctagacctcaagaatgctaaagctgaaggcaggaacatggaggtcttctattctcaacttctccatctggaagatataccattcttacatcatgtgcataaggtgggaaagtggctgagaaaatggcagccctgagaggggaaaccttaggcaagtgcacagagcagacttgtagcaattggcactagaaccagacacctagacactcagtcctcagtccatactacattctgaaaggctctgtgtctttaatgctactctattcttaaacagccacatgtgggattactttaaatcatcatatgagattagtcaagtaacccaagggaacttttcctttcattctttctgcacaagccctttccaacacaggactctctcctctctcactgggccaccatggcttgggaagggtccagtatagatggatgggcagacactgagtggcctctgctccttgtctccaggcaacctttaaaggctggatggacattatgtatgcagctgttgattcccgggaggtgagtctcagcccactgtccctacagccttcccctctgtgcattctacccatatcagtctgcatttgaaatgaagtgacgatgaccctggtactggaagaggcgatcacccagcaacctcacactgtccctccttgcagcagtgtccagctggctctctgttgagtgtttcagccaccgaggctttccccctttcatctacactccccaggcttctcgaggttttcctctgttcactgttgaggaaagcatcagataacctctaagagacagttcatgtgagccactccctggacaagggtgggagcaaagcaagggtagtagctaaatcaaggtgcatagggaggaatgaggtagaatctcaggaactatcataaaacccaggatgggccaggcgcagtggttcatgcctgtaatcctagcactttgggaggccgaggtgggcagattgcctgagctcaggagaccagcctgggcaatacggtgaaaccccatctctactaaaatatgaaagaaattagcagggcatggcggcttgtgcctgtagtcccagctgctcgggagactgagacaggagaatctcttgaacccgggaggcagaagttgcagtgagctgagattgcgtcactgcactccagcttgggcgagacagcgagactcaatctcaaaaaaaaagaaaagaaaagaaaaagccaggctggggagacactattggggaatgaccacttcctgctgtggcaggcactgtcaattccctgccacctcttcccttagcccacttctgatttcacctgcaggctgcacttctgattctctgtataaagactccagggcttaggagcttgtgcagcaacttctcccccaagtaccagggatttaatgtccctaggggcaacccttaccaataagttttgggagtctgaggataaatactccagtttccctgtcccttggtgatataatcctgcatgtgctctacacagttactcagaggaccccagtaggattgcgcttcagttgcccacaatgatgccctgcttaacaacatcctcttcacaggctcttctcccattcccgcttattcttccccactccctcattcctgcttccttggatcacctcccagataaatcacctgcacccaggtccatgtcttaggcttggctttcagagtgaacctgaactaagacacccaccctccttcccactctcccttgtctggtcacaggtcaacatgcaacccaagtgggaggacaacgtgtacatgtatttgtactttgtcatcttcatcatttttggaggcttcttcacactgaatctctttgttggggtcataattgacaacttcaatcaacagaaaaaaaagataagtggtgctcaggagtttctggtttctgctgtagtggtaagccttatatttcctgttccctgcccagctctggcctcctgacaaaagccaacactactcacagcccatcactttaatatcagtgctaacccttgccctgtgattgctgttgcaggaagagttgcatttctctctgtcagcaatgccccactaacatcctcactcaggattcacatctcaaagggatcttggtcttcccaactggaaccaggtgtgttagatgtgttccaagtgagccctgggagaatacaagcagggaaagaaagggatctagaacttgctgacctgttgggggatatgatccccacaaaggactgagtcagggcacctcaggaaaggccatggcccagcactggcagaatcccaaccctccttgggatggggaggaaggcttgtgcctccaagggtgccgactctgattaataggaatcgaatcccagataacctctcatgtttataagaaaatgtcagggcaataaaggtataaagtattttcctattatcctttcatttaatgccttccatacccctgaggtagataggcgctgttctagatttgcgtaactgagatcccgagagaaaaggggctacatggataagtcacagagtacatgcaaacctgggtttgcattcctgactcaactacttgtggatggctcatgctggcaatattttaaacccctctgagtctcagttttctcattcattcaatggggctaataatacctactctctggattgtggtgaggggtaaacaaaatcctgaacaaagatcactgagcataagacaactttggtggtgcagtttctggcactgtaacagcagaggggagtgtgactggcagcgcctcaagagcaccagatgctgttgctattaacaatttaaaatatatacctactagggcaggcattccacttacaggaaatccttgcccagggttctgagcataagaagaggacaggataggtctgggacaagacagtgctatttagtaccctggggaggtttgagattattgaagcaatcatttctctcattttacagatgagaaaactgaggtcaagaaacagattacagagggagatattaggtaacggaaggagatgagctagtgaccaggctggggtcactgagaaactgcatctactgaatccttggtcagagttctcagcatgacctcacctggagctcacctacccactgcccttgccctttccttctctccccccataaagatggtcctcccaggaagccctttgtgtccacagatcttctcagatctcctttcaaattccacagatctcagcccagtttcccagcatttgcagggactaacttacataaacatgttattaaaataggtggctttcaaattatgtcaggaagctaaaggtgagagtttgaatgaagaaaatccaaagggcccctaaagaaaaactaatacccaatcctaagggaggaaaacatcttcgttggtgcagtttctggcactgtaacagcagagggcagtgtgactggcagggcctcaagagaaccagaggtccctctgagaccaaggacccaaggataaggcagtaattgtcctcatctcctcctctccagaaaagatttgagggcttctgtccctcccagagtctttgcttcaaggtcctcaggaaatctcttgccccctgggagggactgtgactctagaagcccaaagaattttactggaatgaacaggctagatccaaggctcagatttgaaccaacatgtaccttctccttgagtcctgtttaccaaccctccccaccctttatccagcatctctggatccctggagaacagaaactggctttgctttagagacccaggcagggagtcagcaatggaactcagtcccaccgttccgacactggatgtggcaagacactccttgatgctgggcttggtttgtctatctgcagaggaggggagaaggttgatatgatcctttctctcctgcctgttctgattttggtatccgtagggggttcctcttgctttagtaacagtgtggccctctctgcacttagggggccaggacatcttcatgacagaggagcagaagaaatactacaatgccatgaagaagttgggctccaagaagccccagaagcccatcccacggcccctggtgagccccagaggtttcctctagcacagcctgtctgtgaatccaacatgacagtctatgcctgtgtcaggcaggggcctgagggagtgctgtttatggaagagaagatctgggttgacgttgggatgagggtgatgagggttcctaggcccaaggaatgagaagttcaaaagaagcaactctggtcttctggagtaaacataccttttacagctatttgaaatgaatctgttgggggaagcactgagtttctccaacagttttagagttcaagtacaggattggaggcaggttaagctaagtgacagtaagggtagttagaacccagggattaaacttgtgtggttatgtatcatggtctaggtcgcagtagatctccagtatcaccctatattctaccccacgcctacaggtatagagaggaaatgacaacaacccaactcccctgtcaggatccaagatgcagtcatggtagtggtcaagtggcccagtaggaaccaaaagttatcccactcgagtttaaagattgggcaaaaattagggccagactctagtttcactccttttttcataaagatctcaagagacatggctttgcgttcctccattaaatgtactacccataccacacatgatatcacctaagttcttctcagtcttctgccagaagatagaaaacatcaagcctctgagaggccctaagatagcacttttttgggaatggatgaacaggtttgggggtgaagatgttgatgtgtcagaaattattgttgatcgtcttcaaagaatttctgagccatccactccagtgaatggaattggccctgtgtccttctacataaactttctgtggctaagatgcagcattagtgaagaaaatcacaggtattgctgatgacacaatttcattagcccttccccacacaagggaaaagtccaaaggacatttaacaaaggaacaagcctttccctaaatgaattatggagacatgcattctgttagccaagctattagatttttttaaatcaaggtataggatttgcataatttacttcaaactttgtcagaacaaagtgaaaaacatttacaagagaaaaaagtgatgacttttgacactgtattttgaaatagtggtcatgaatttattactagtctagattctgataagaagtattacaatggggagtggggagtgataggaggttcagacctctgtaggggcacagctttcttcctaaatcacccatacaatcaagataactggatttgagtgaacctgagcaaaagtccttaggctcattgagtatccctccatcaacaagttcagtggagaggagcaggctcaaaattaaaattaggtgaaaggctgagtcccaaccacattcaagtcatgggtaatgagaggaggaccctaagacttactgagaagcaagcagctgagtccacactggcctttacttgtggctggagtaagattgaatccacatttgagccagatgccaaggaggtgtgtgctagggacaacccttggcaaaaacatgaaagtttttggcaccttcccccacatactactcaatctctctttgacatcccagcttcttccctgtcatcacccaaccccataggctgccaaagaaagcttcctcccctcaaggaagacaacattcttaggacaagataaatcatatttcaaaaagggaccctggagagggcatctacctacaaaggcatgaccctaatgttgaaattccaggcagtaaataggagtgggagacggagttgatggtcaggcaggaagacctgcaacaaaatcaccatttctcctaattaagctgcaactaagatcctccgaggatggcacagggggagacctccacatgtggaggggaagtgaaacctcataaccaattctgttcctgagattctccatcctttgaatggaagaagagtggattagtaattcactctcaaccttttgctagccttagtggaggaacgtggctctccccttaatattctggcccaagcaaggtaaacactctttcctttgttccctaatttcgcatagctgaggcaaggctagaacatttaaacaaaactttgaagtggcagggatgccaacagagaaatcagcacaaagcagagtccaagcagcacctgcagatggctgcactccaggacccataggtcttggaccatcctagctcctgaccagcatccaaatggcaggcaacatctttgacacccacatgcccagtggcacaagccggatcatcttccctcttcaaagtctagaaccaagaaagaaatccaaggcaaaaggaaattcccactcccaactaagacccttcttcccaggcccagcttgcttttggccagattattggccctggaatgtccaccttctccccttaggagccccaaaggtcaagctggtcataccagcaaagcactgacacaggatttctgccccatcagtgcatgggtgccatttcatgacagagcttacctgggaccacataggagcctcacacacctcctctcacctctgatgatgctcaggctctaaatcttgtttcttccataggaaaagttaaggattccacaagactgggaaattttattctttaacattccctgctacagaaatcaataaaagcagctctcacatactccactttatagaaatataataggctctagagaatatcacataatcaatcacccacttcatcgtctctgagagcaccaagggttgcaaaggtatgatccctgaccgtgggctaatccaagagcagctagcaagctactccattccctaaagtcagaatatccagggcaaacttcacacccagccacttaacgatgccgttgcctgctctgtttaattagaagtcatgtgaccatgaatgggcctgtattttttcaccattttcagtgatgaaatggaagggattagtggctcagcaatccccctcctgccccaggaaagatgtgagccagcagttctgccatgagcaaaggccactttggtctgattctttgctctaacccaacaggatagcaacccatccccaccatgaagcagaaggcaaggatcagcctcatcacagcacttccccctctgcttgctgtgcagctcccgtgggctccctggaagggatcagacaggttcttctcttcctccctcatagccactcatgcagaggcttgcacatcccatacattcagtatgtacccttggtacagaattgaatttagtcaaataaagggtgactttaaattttcatttgagctatggttaactcagagctgcccattctgtcttccattcatttacaaatttgcagagcatctgttgcagccaggcactatgcagacaccagggttagagcagtgagcaagacagacaaagttcctactcttacagtttacagtccagtgacagaggcaaacagttggccaaaagttgcacatatatgttaattcctggctggataaattgtcaagggagaaaaaatggggtgaagagcaaaggatgctcaagactgagcctcgaagaactctgatgtctaaaagttgggtaaaggagactataaaagagcatcacaaatggcaagaaaagaagcagaaatgtaaggcatggtggagaccaagaaagcaacatttcaaggtagaagggtactaggcaatatcagacaagcgtccttggatctaatattatgggaagtcattcatgatcttagtgagaacaatctctgtcaggatagaggcaaaagctctgttgatgtgggctgaggagtgaatgagggacactgattgtacacaactctttcaagaaattttgctttgaaggtgggaagagatctaagatggtagctggagggagatgtaagtttctgaaatattctgctttaagttaggagaaactaggtcattagagatttgtgcaataaaccaagagacaaagagtaatgcacatggacattaatgttgcctaggataatagccaagagtgggcaaatatggccaagagcctcacccatcattactgaggcagagggaccaagagtttggcaagcggcagtaatgaagaagtgacaaaactaggtggcaaagcttcaaagcaagaaggggttttacaagacacaggaagagcagtggtgtggaagggtcagtggtgaacaaggagaacgccaggcctaacccctgaggtacatggggtaggggagaatggcagcctttgaatagggggagatatgtgcagatcaaggcaggtgagctccatagaggtcaggagaagttttgggagaaggtcaaagcgtggggaatggggttgggatcaaggactcacagagcagtaagatgttcacagcactaaaagaagagaagatcacagtaggagctttttaaagacaccataaaaataaccagatataaatgatctcttggttatccaggccactctgcctccttccaagatgcaaacaaccaagacttgaccctacgccctatacctgcatttgcttaggcatttgcacagcaccaggaacagagggaacatttccaagaataagtttcccctttgcacttgactttactctcagcaaagtagctcaaattaatatttcaagcagctcttgaactcttgcaatgtgcagggcactgcagggaaacaaagttaaggaaggtatagcccttgtcctcaaacagctcattgtctagtagagaagacgcatatacaaaatgctagaactcgaggctgactgaaaagtgggatccccaaagggacagggtagtgtgttgtcacgtgactaagggacactccatgcagtaagtggagcttaaaagagatggattactcaagactgttggaatttagacagccaagagaggagataggagggcattgtgaatagaggcaagggcacagaccaggacaaaagaagggcctggtggcatcaaagggccaggagaggtattaaggacttgaactggggcaatgaggtagagtcaactaaaagtgaaattttggaagaggtaaggatagtatttcgcttctgttaagatgtggagtgtgatggagacaaaactcatctacagataacacagatgcctggtttgtgctggcccaaaggccctgatgccactatctcttgttttctcagaacaagttccagggttttgtctttgacatcgtgaccagacaagcttttgacatcaccatcatggtcctcatctgcctcaacatgatcaccatgatggtggagactgatgaccaaagtgaagaaaagacgaaaattctgggcaaaatcaaccagttctttgtggccgtcttcacaggcgaatgtgtcatgaagatgttcgctttgaggcagtactacttcacaaatggctggaatgtgtttgacttcattgtggtggttctctccattgcgagtaagtgggcagccacgtggtggggaagccccacctctgtttgggggtctttgggatgctcttctaaaaccaaggaaataaccaaccaactttttgaaatacgtgtttatgttagaagaaccctgtatttgcagctttccaagagtagcaagttttaaatgccttgggctgctctctcagtgaaatgaagaggttctcttggccttctccatgctcacacgaagtgttttcaggcacctactgtgtgcacagcccatggctagaacctcaggggctgacagggaataatcactcctcctgagaacctcagaccgtaagatgatggagtctccagcagaccttacttttatggtcttgaaagcagggggcaggtggtgtaatgtgagatgagtcttaaaatctgttctggaaaaggagatggattgccatcaaagtgaggaaagactgggaggagattgttcaaaggagattctcaagtctagggtctggaattaaatctctacacaactgttctattagggaacatgagtgatagaaaagtcaagatatcaatgccaagaaattaatactgttaaggcccagtctgggtgttgttgaatgacaggcccagtattttgggtccagtggtgttcagagaaaattactagagttagaggctaacatggggaaatggagctgccttgactgaatacttcctaagttctgagcactgagctgggctccatgaatgttcacagcagccctgtcaagcaggtgttattatccttattttatacatttaaaattgagactcagagatcaagaatattatgcagggtcacagagtttccaagggttgaagctgagtttagaacaggctccaatcttctaatgaacttgctgcctgtcaccaacagccaagagactgtccctgggcttatgggttagctgaagtttgaccctataaaggccaaatcatgctcaccagcttcacctggcattataaatgtatcttgattggttatatcctgacctgcttacttttcatgtcggggtgtagctgtagatttaatttgccactgatttagtaacaagagctgagagtatctaaatacaacttaacagcatttcatcaacctccccaccttggtgctgaaacacagccttgggttgcgtgtatttccggggatttcagtttgtttttgttcttgttttattttgatattgctgctctgttttttaacactttattgaggtatgatccacatgtaaaaagctatacatgtttaatgtacacaactttatgagtttggagataagtatacacccatgaaaccatcaccaccatcaatgccagaaacatgtccataacctccaaatatttcctcctgcctatttatttatttattgggtgctaggaacacttaagatttattctcttggcaaatttttaggtagacaacacggtattgctaactatagggactatgctataagtagagctctaggatttattcatgtcacataactggaagtttgtacactttgacaagtacctccccaatttcccctcctcccagctcctggaaaccaccattctattctctgctcccatgagtttgactattttagattccttatataaatgcaatcatgtcgtttttgtccttctgtgtctggcttatctcacttagcataataggagtttttgttggttggttggttagttgttttcatttttgttttgttttgtttgtcttccaaaatgaaagattccaaaggctattttgattttatattaaagaagggagcttgtttgtgtatcagtaatatagaaataaaacatagccaagtacttagttctatgatggggatatcttaactaccagttcctgtggcttacagggtagcaccatccgctggggcaggaatcccttatagagctggaaaataagcagaaaaaacccacatatcaatctttctaccctctctccttacctccctttcttctttcccaccaacaagaggtgattgagtatctaattgttacaagtacgaggaaccattctcccttaaaataagatcctggagcaaattaaaatgtgctgtagaccagttgtctggcagaaaattttaccagagtatgtagacaaataatgtaccctacacgatgggaacatgtcctagttaaactggaaattcacagaaggtcttccacaaagattttataatccaaaattataattatttcccaagtccccttctactttcttcctctttccaacacaatattgtgacccatgtgcataacaacaaagagcaagtaggggagagggcccagggaacctggcaaggagcgagagcttgctgctacatccctcaccatttttcctgtgagatgttgaaccctctcttacctaaaggccttgcctcatctttggtggaggcctttggtacaaataaggctccccaggtccccaagaccaaaaatcaaacatcttcaagttagacatcatatagagggacatatacattctttatatttccaactttgttcatagttggagttgggggcagtaactgactcccccaaaaaaacctatctccaggccctaacataaagttcaaaaacagctggaaccgaaaaaaaaaaaaaaaaaacaaattaaggcattgtgcagacagctggtcattcaaatcccttatgctttagctgtcagccagttgcccgaatcctcaggcccccttgtaattaacaccaggctccgtacaattagccacaggaccgggtgccagaaacagagtcaatcttcacagtaggaggtagggagaggaatcataaggggtcctggccttcacagagcacaggaccagggtggaggaaagggcatgacccaaaggctgcagtatcagggaggagcagggtctgtgtcataggaaaaaacaggccaaagactgtgagcctgtggaataaactgcagtcacttccagctgaacttggctgcagaagataagtttttgactgtggaggttgaccaagaggatattctaggcggaggcaaagataacatggtaggaagggtaagacggaggaggaagagaggacttatgcaatgggcatttactgagcccctactttgtgctacctaccatgccaggctctgagggcccagagtcctcaaatgtggatgcccaagtggcagtctataccaagcaaagcagagtgtcatcacagccaactttgtcacgtctcatggctggagatactaattagataatttcttccttcttttaaaggcctgattttttctgcaattcttaagtcacttcaaagttacttctccccaacgctcttcagagtcatccgcctggcccgaattggccgcatcctcagactgatccgagcggccaaggggatccgcacactgctctttgccctcatgatgtccctgcctgccctcttcaacatcgggctgttgctattccttgtcatgttcatctactctatcttcggtatgtccagctttccccatgtgaggtgggaggctggcatcgacgacatgttcaacttccagaccttcgccaacagcatgctgtgcctcttccagattaccacgtcggccggctgggatggcctcctcagccccatcctcaacacagggcccccctactgtgaccccaatctgcccaacagcaatggcaccagaggggactgtgggagcccagccgtaggcatcatcttcttcaccacctacatcatcatctccttcctcatcatggtcaacatgtacattgcagtgattctggagaacttcaatgtggccacggaggagagcactgagcccctgagtgaggacgactttgacatgttctatgagacctgggagaagtttgacccagaggccactcagtttattaccttttctgctctctcggactttgcagacactctctctggtcccctgagaatcccaaaacccaatcgaaatatactgatccagatggacctgcctttggtccctggagataagatccactgcttggacatcctttttgctttcaccaagaatgtcctaggagaatccggggagttggattctctgaaggcaaatatggaggagaagtttatggcaactaatctttcaaaatcatcctatgaaccaatagcaaccactctccgatggaagcaagaagacatttcagccactgtcattcaaaaggcctatcggagctatgtgctgcaccgctccatggcactctctaacaccccatgtgtgcccagagctgaggaggaggctgcatcactcccagatgaaggttttgttgcattcacagcaaatgaaaattgtgtactcccagacaaatctgaaactgcttctgccacatcattcccaccgtcctatgagagtgtcactagaggccttagtgatagagtcaacatgaggacatctagctcaatacaaaatgaagatgaagccaccagtatggagctgattgcccctgggccctagtgagaacactccagcctggatatgttcagttatgatgcgtccttctgctctgtgttaactctttcccattgcagatcacacccagctacagcctcaccaatgcatgccactggtcacaatgtcagaactgggcagggaatgcaactggtaaccacctttgaaaaaaccatcatacacaaataggagtcagaagctaagagcacttccactgtgatttcccttctgaatttcaatatcagatcatgggttctcttactctccagaaaatatcccttgtccttttatttttgttgtaatcagattatatttactgagacaaacttctcaggaccagaacttccaaagatatagaacaagaacattactgaaggtccaaggtagtcctctgtggagcaccatacagagattggcaatattatttaggattttgcatgactgcatgtgagagctgtcggacaactgctctgacccagggtaacacctgtggcctatgtcatgaaaagcctttgagatatccattaaaattaatatttttaaatgta

SEQ ID NO: 652 - DNA, 20 bp, artificial
  sgRNA sequence used in Nav1.8 activation
ggcaagctgtcacctctctg

SEQ ID NO: 653 - DNA, 353 bp, Artificial
  full sequence of the U6 promoter-sgRNA
gagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggcaagctgtcacctctctggttttagagctagaaatagcaagttaaaataaggctagtccgttatcaacttgaaaaagtggcaccgagtcggtgcttttttt

The invention claimed is:

1. An oligonucleotide of 10 to 30 nucleotides in length comprising a contiguous nucleotide sequence of 10 to 30 nucleotides in length and having at least 90% complementarity to SEQ ID NO: 1, wherein the oligonucleotide is capable of inhibiting the expression of Nav1.7 and Nav1.8 in a cell, and wherein the contiguous nucleotide sequence is complementary to human Nav1.7 and human Nav1.8 target nucleic acids, wherein the oligonucleotide comprises at least 10 or at least 12 contiguous nucleosides present in a sequence selected from the group consisting of SEQ ID NOs: 512, 513, 514, 515, 516, 517, 518, 519, 520, 521, 522, 523, 524, 525, 557, 558, 559, 560, 577, 579, 583, 638, and 587, and wherein the oligonucleotide is, or forms part of, an RNAi agent.

2. The oligonucleotide of claim 1, wherein one or more nucleosides in the contiguous nucleotide sequence is a 2′ sugar-modified nucleoside.

3. The oligonucleotide of claim 2, wherein the 2′ sugar-modified nucleoside is independently selected from the group consisting of a 2′-O-alkyl-RNA, 2′-O-methyl-RNA, 2′-alkoxy-RNA, 2′-O-methoxyethyl-RNA, 2′-amino-DNA, 2′-fluoro-DNA, arabino nucleic acid (ANA), 2′-fluoro-ANA, and LNA nucleoside.

4. The oligonucleotide of claim 1, wherein the oligonucleotide or contiguous nucleotide sequence thereof comprises one or more LNA nucleosides.

5. The oligonucleotide of claim 1, wherein at least one internucleoside linkage in the contiguous nucleotide sequence is a phosphorothioate internucleoside linkage.

6. The oligonucleotide of claim 5, wherein all of the internucleoside linkages within the contiguous nucleotide sequence are phosphorothioate internucleoside linkages.

7. A conjugate comprising the oligonucleotide of claim 1 and at least one conjugate moiety covalently attached to the oligonucleotide.

8. A pharmaceutically acceptable salt of the oligonucleotide of claim 1.

9. A pharmaceutical composition comprising the oligonucleotide of claim 1, and a pharmaceutically acceptable diluent, solvent, carrier, salt, and/or adjuvant.

10. An in vivo or in vitro method for inhibiting SCN9A expression in a target cell expressing SCN9A, the method comprising administering the oligonucleotide of claim 1 in an effective amount to the cell.

11. The method of claim 10, wherein the cell further expresses SCN10A, and the administering further inhibits SCN10A expression in the cell.

12. A method for treating or preventing pain in a subject suffering from or at risk of developing pain, the method comprising administering a therapeutically or prophylactically effective amount of the oligonucleotide of claim 1 to the subject, thereby preventing or alleviating the pain in the subject.

13. The method of claim 12, wherein the pain is:
    (i) chronic pain, neuropathic pain, inflammatory pain, spontaneous pain, or nociceptive pain;
    (ii) pain caused by or associated with a disorder selected from the group consisting of diabetic neuropathies, cancer, cranial neuralgia, postherpetic neuralgia, and post-surgical neuralgia;
    (iii) pain caused by or associated with inherited erythromelalgia (EIM), paroxysmal extreme pain disorder (PEPD), or trigeminal neuralgia; or
    (iv) visceral pain or mixed pain.

14. A pharmaceutically acceptable salt of the conjugate of claim 7.

15. A pharmaceutical composition comprising the conjugate of claim 7 and a pharmaceutically acceptable diluent, solvent, carrier, salt, and/or adjuvant.

16. A pharmaceutical composition comprising the pharmaceutically acceptable salt of claim 8 and a pharmaceutically acceptable diluent, solvent, carrier, salt, and/or adjuvant.

* * * * *